(12) United States Patent
Iversen

(10) Patent No.: US 7,049,431 B2
(45) Date of Patent: May 23, 2006

(54) ANTISENSE ANTIBACTERIAL CELL DIVISION COMPOSITION AND METHOD

(75) Inventor: Patrick L. Iversen, Corvallis, OR (US)

(73) Assignee: AVI Biopharma, Inc., Corvallis, OR (US)

( * ) Notice: Subject to any disclaimer, the term of this patent is extended or adjusted under 35 U.S.C. 154(b) by 37 days.

(21) Appl. No.: 09/754,468

(22) Filed: Jan. 4, 2001

(65) Prior Publication Data

US 2005/0192237 A1    Sep. 1, 2005

Related U.S. Application Data

(60) Provisional application No. 60/174,484, filed on Jan. 4, 2000.

(51) Int. Cl.
  *C12Q 1/68* (2006.01)
  *C12P 19/34* (2006.01)
  *C07H 21/02* (2006.01)
  *C07H 21/04* (2006.01)

(52) U.S. Cl. .................. 536/24.5; 435/6; 435/91.1; 536/23.1; 536/24.31

(58) Field of Classification Search .............. 435/6, 435/91.1, 455, 458, 91.31; 514/44; 536/23.1, 536/24.5, 24.31
See application file for complete search history.

(56) References Cited

U.S. PATENT DOCUMENTS

| 5,821,052 | A | | 10/1998 | Chen et al. | |
|---|---|---|---|---|---|
| 5,977,340 | A | | 11/1999 | Colote et al. | |
| 6,060,456 | A | * | 5/2000 | Arnold, Jr. et al. | 514/44 |
| 6,133,246 | A | * | 10/2000 | McKay et al. | 514/44 |
| 6,228,579 | B1 | * | 5/2001 | Zyskind et al. | 435/6 |
| 6,239,265 | B1 | * | 5/2001 | Cook | 536/23.1 |
| 6,495,663 | B1 | * | 12/2002 | Rothbard et al. | 530/329 |

FOREIGN PATENT DOCUMENTS

| EP | 0 892 064 A2 | 6/1998 |
|---|---|---|
| EP | 0 894 857 A2 | 7/1998 |
| WO | WO 98/03533 | 1/1998 |
| WO | WO 98/32467 | 7/1998 |
| WO | WO 99/02673 | 1/1999 |

OTHER PUBLICATIONS

Branch, A. Trends in Biochem. Sci. vol. 23, pp. 45-50. 1998.*

(Continued)

*Primary Examiner*—Sean McGarry
*Assistant Examiner*—Jane Zara
(74) *Attorney, Agent, or Firm*—LeeAnn Gorthey; Perkins Coie LLP

(57) ABSTRACT

Antisense oligomers directed to bacterial cell division and cell cycle-encoding nucleic acids are capable of selectively modulating the biological activity thereof, and are useful in treatment and prevention of bacterial infection. The antisense oligomers are substantially uncharged, and contain from 8 to 40 nucleotide subunits, including a targeting nucleic acid sequence at least 10 nucleotides in length which is effective to hybridize to (i) a bacterial tRNA or (ii) a target sequence, containing a translational start codon, within a bacterial nucleic acid which encodes a protein associated with cell division or the cell cycle. Such proteins include zipA, sulA, secA, dicA, dicB, dicC, dicF, ftsA, ftsI, ftsN, ftsK, ftsL, ftsQ, ftsW, ftsZ, murC, murD, murE, murF, murG, minC, minD, minE, mraY, mraW, mraZ, seqA, ddlB, carbamate kinase, D-ala D-ala ligase, topoisomerase, alkyl hydroperoxide reductase, thioredoxin reductase, dihydrofolate reductase, and cell wall enzyme.

6 Claims, 5 Drawing Sheets

OTHER PUBLICATIONS

Palu, G. et al. J. Biotech. vol. 68, pp. 1-13. 1999.*
Pihl-Carey, K. BioWorld Today, vol. 10, pp. 1-2, Dec., 1999.*
Crooke, S.T. Antisense Res. and Applica. pp. 1-50. S. Crooke, ed. Springer. 1999.*
Agrawal etal. Molecular Med. Today vol. 6, pp. 72-81, Feb. 2000.*
Chirila et al. Biomaterials vol. 23, pp. 321-342. 2002.*
Gilbert et al. J. Clinical Epidemiology vol. 54, pp. 68-85. 2001.*
Zollinger et al. Transactions of Royal Soc. of Tropical Medicine and Hygiene. vol. 85, Supp. 1, pp. 37-43. 1991.*
Hudziak, R.M. et al. Antisense & Nucleic Acid Drug Dev., vol. 6, pp. 267-272 (1996).*
J. Summerton, Biochim et Biophys. Acta, vol. 1489, pp. 141-158 (1999).*
Joseleau-Petit, D., e, al., Journal of Bacteriology, 181:9-14, (1999).
Uhlmann, E., et al., Chemical Reviews, 90:543-584, (1990).
Van Helvoort, M., et al., Journal of Bacteriology, 178:4289-4293, (1996).

Search Report PCT/US 01/00222.
Form PCT/ISA/206 Communication Relating to the Results of the Partial International Search for Application No. PCT/US01/00222.
Good, L. et al., "Inhibition of Translation and Bacterial Growth by Peptide Nucleic Acid Targeted to Ribosomal RNA", *Proc. Natl. Acad. Sci. USA,* vol. 95, pp. 2073-2076, Mar. 1998.
Rahman, M.A. et al., "Antibacterial Activity and Inhibition of Protein Synthesis in *Escherichia coli* by Antisense DNA Analogs", *Antisense Research and Development* 1:319-327, 1991.
Jayaraman, K. et al., 'Selective Inhibition of *Escherichia coli* protein synthesis and growth by nonionic oligonucleotides complimentary to the 3' end of 16S rRNA, *Proc. Natl. Acad. Sci. USA,* vol. 78, No. 3, pp 1537-1541, 1981.
Good, L. et al., "Antisense Inhibition of Gene Expression in Bacteria by PNA Targeted to mRNA", *Nature Biotechnology,* vol. 16, pp. 355-358, Apr. 1998.

* cited by examiner

ANTISENSE ANTIBACTERIAL CELL DIVISION COMPOSITION AND METHOD

This application claims priority to U.S. provisional application Ser. No. 60/174,484, filed Jan. 4, 2000, which is hereby incorporated by reference in its entirety.

FIELD OF THE INVENTION

The present invention relates to oligonucleotide compositions antisense to bacterial nucleic acids involved in cell division and the cell cycle, and to methods for use of such compositions in the treatment of bacterial infection in a mammal.

REFERENCES

Agrawal, S. et al., *Proc. Natl. Acad. Sci. USA* 87(4):1401–5 (1990).
Bonham, M. A. et al., *Nucleic Acids Res.* 23(7):1197–1203 (1995).
Boudvillain, M. et al., *Biochemistry* 36(10):2925–31 (1997).
Cross, C. W. et al., *Biochemistry* 36(14):4096–107 (Apr. 8, 1997).
Dagle, J. M. et al., *Nucleic Acids Research* 28(10):2153–7 (May 15, 2000).
Ding, D. et al., *Nucleic Acids Research* 24(2):354–60 (Jan. 15, 1996).
Felgner et al., *Proc. Nat. Acad. Sci. USA* 84:7413 (1987).
Gait, M. J.; Jones, A. S. and Walker, R. T., *J. Chem. Soc. Perkin* 1, 1684–86 (1974).
Gee, J. E. et al., *Antisense & Nucleic Acid Drug Dev.* 8:103–111 (1998).
Huie, E. M. et al., *J. Org. Chem.* 57:4569 (1992).
Lesnikowski, Z. J. et al., *Nucleic Acids Research* 18(8): 2109–15 (Apr. 25, 1990).
Matteucci, M., *Tetrahedron Lett.* 31:2385–88 (1990).
McElroy, E. B. et al., *Bioorg. Med. Chem. Lett.* 4:1071 (1994).
Mertes, M. P. and Coates, E. A., *J. Med. Chem.* 12:154–157 (1969).
Miller, P. S. et al., in: Antisense Research Applications, Crooke, S. T. and Lebleu, B., Eds., CRC Press, Boca Raton, Fla., p. 189. (1993).
Stein, D. et al., *Antisense &Nucleic Acid Drug Dev.* 7(3): 151–7 (June 1997); see also
Toulme, J. J. et al., *Biochimie* 78(7):663–73 (1996).
Vasseur, J. J. et al. *J. Am. Chem. Soc.* 114:4006 (1992).

BACKGROUND OF THE INVENTION

Currently, there are several types of antibiotics in use against bacterial pathogens, with a variety of anti-bacterial mechanisms. Beta-lactam antibiotics, such as penicillin and cephalosporin, act to inhibit the final step in peptidoglycan synthesis. Glycopeptide antibiotics, including vancomycin and teichoplanin, inhibit both transglycosylation and transpeptidation of muramyl-pentapeptide, again interfering with peptidoglycan synthesis. Other well-known antibiotics include the quinolones, which inhibit bacterial DNA replication, inhibitors of bacterial RNA polymerase, such as rifampin, and inhibitors of enzymes in the pathway for production of tetrahydrofolate, including the sulfonamides.

Despite impressive successes in controlling or eliminating bacterial infections by use of antibiotics, widespread use of antibiotics both in human medicine and as a feed supplement in poultry and livestock production has led to drug resistance in many pathogenic bacteria.

Antibiotic resistance mechanisms can take a variety of forms. One of the major mechanisms of resistance to beta lactams, particularly in Gram-negative bacteria, is the enzyme beta-lactamase, which renders the antibiotic inactive. Likewise, resistance to aminoglycosides often involves an enzyme capable of inactivating the antibiotic, in this case by adding a phosphoryl, adenyl, or acetyl group. Active efflux of antibiotics is another way that many bacteria develop resistance. Genes encoding efflux proteins, such as the tetA, tetG, tetL, and tetK genes for tetracycline efflux have been identified. A bacterial target may develop resistance by altering the target of the drug. For example, the so-called penicillin binding protein (PBPs) in many beta-lactam resistant bacteria are altered to inhibit the critical antibiotic binding to the target protein. Resistance to tetracycline may involve, in addition to enhanced efflux, the appearance of cytoplasmic proteins capable of competing with ribosomes for binding to the antibiotic. Where the antibiotic acts by inhibiting a bacterial enzyme, such as for sulfonamides, point mutations in the target enzyme may confer resistance.

The appearance of antibiotic resistance in many pathogenic bacteria, in many cases involving multi-drug resistance, has raised the specter of a pre-antibiotic era in which many bacterial pathogens are simply untreatable by medical intervention. There are two main factors that could contribute to this scenario. The first is the rapid spread of resistance and multi-resistance genes across bacterial strains, species, and genera by conjugative elements, the most important of which are self-transmissible plasmids. The second factor is a lack of current research efforts to find new types of antibiotics, due in part to the perceived investment in time and money needed to find new antibiotic agents and bring them through clinical trials, a process that may require a 20-year research effort in some cases.

In addressing the second of these factors, some drug-discovery approaches that may accelerate the search for new antibiotics have been proposed. For example, efforts to screen for and identify new antibiotic compounds by high-throughput screening have been reported, but to date no important lead compounds have been discovered by this route.

Several approaches that involve antisense agents designed to block the expression of bacterial resistance genes or to target cellular RNA targets have been proposed, including the use of peptide nucleic acids (PNAs; see Good, L. and Nielsen, P. E., *Proc. Nat. Acad. Sci. USA,* 95:2073–2076, 1998a) and the use of three- to six-nucleotide methylcarbamate DNA analogs complementary to prokaryotic 16S rRNA (Rahman, M. A., Summerton, J. et al., *Antisense Res. Dev.* 1(4):319–27, 1991). A peptide nucleic acid (PNA) antisense sequence designed to target the start codon of the *E. coli* beta-galactosidase and beta-lactamase genes exhibited concentration-dependent, specific inhibition in vitro at nanomolar PNA concentrations and in vivo at micromolar concentrations. (Good, L. and Nielsen, P. E., *Nat Biotechnol* 16(4):355–8, 1998a). However, in general, these approaches have been marginally successful, presumably because of poor uptake of the antisense agent (e.g., Summerton, J. et al., *Antisense & Nucleic Acid Drug. Dev.* 7(2):63–70, 1997; Good, L. and Nielsen, P. E., 1998a, cited above).

There is thus a growing need for new antibiotics that (i) are not subject to the types of antibiotics resistance currently hampering antibiotic treatment of bacteria, (ii) can be developed rapidly and with some reasonable degree of predictability as to target-bacteria specificity, (iii) are effective at low doses, meaning, in part, that they are efficiently taken up by wild-type bacteria or even bacteria that have reduced permeability for antibiotics, and (iv) show few side effects.

SUMMARY OF THE INVENTION

In one aspect, the invention provides an antibacterial compound, consisting of a substantially uncharged antisense oligomer containing from 8 to 40 nucleotide subunits, including a targeting nucleic acid sequence at least 10 nucleotides in length which is complementary to (i) a bacterial tRNA sequence or (ii) a target sequence, containing a translational start codon, within a bacterial nucleic acid which encodes a protein associated with cell division or the cell cycle. Each of the subunits comprises a 5- or 6-membered ring supporting a base-pairing moiety effective to bind by Watson-Crick base pairing to a respective nucleotide base in the target nucleic acid sequence. Adjacent subunits are joined by uncharged linkages selected from the group consisting of: uncharged phosphoramidate, phosphorodiamidate, carbonate, carbamate, amide, phosphotriester, alkyl phosphonate, siloxane, sulfone, sulfonamide, sulfamate, thioformacetyl, and methylene-N-methylhydroxylamino, or by charged linkages selected from the group consisting of phosphate, charged phosphoramidate and phosphorothioate. The ratio of uncharged linkages to charged linkages in the oligomer is at least 4:1, preferably at least 5:1, and more preferably at least 8:1. In one embodiment, the oligomer is fully uncharged.

Preferably, the oligomer is able to hybridize with the bacterial sequence at a Tm substantially greater than the Tm of a duplex composed of a corresponding DNA and the same bacterial sequence. Alternatively, the oligomer is able to hybridize with the bacterial sequence at a $T_m$ substantially greater than 37° C., preferably greater than 50° C., and more preferably in the range of 60–80° C.

In one embodiment, the oligomer is a morpholino oligomer. The uncharged linkages, and, in one embodiment, all of the linkages, in such an oligomer are preferably selected from the group consisting of the structures presented in FIGS. 2A through 2D. Particularly preferred are phosphorodiamidate-linked oligomers, as represented at FIG. 2B, where X=NR$_2$, R being hydrogen or methyl, Y=O, and Z=O.

The length of the oligomer is preferably 12 to 25 nucleotide subunits. In one embodiment, the oligomer is a phosphorodiamidate-linked morpholino oligomer having a length of 15 to 20 nucleotide subunits, and more preferably 17–18 nucleotide subunits.

The invention also provides a corresponding method of treating a bacterial infection in a human or mammalian animal subject, comprising administering to the subject, in a pharmaceutically effective amount, a substantially uncharged antisense oligomer as described above.

The targeted bacterial protein is preferably selected from the group consisting of zipA, sulA, secA, dicA, dicB, dicC, dicF, ftsA, ftsI, ftsN, ftsK, ftsL, ftsQ, ftsW, ftsZ, murC, murD, murE, murF, murG, minC, minD, minE, mraY, mraW, mraZ, seqA, and ddlB proteins, carbamate kinase, D-ala D-ala ligase, topoisomerase, alkyl hydroperoxide reductase, thioredoxin reductase, dihydrofolate reductase, and cell wall enzyme. In selected embodiments of the compounds and treatment methods, the bacterial target sequence is a translation initiation region in an mRNA transcribed from a bacterial gene selected from the group consisting of zipA, sulA, secA, dicA, dicB, dicC, dicF, ftsA, ftsI, ftsN, ftsK, ftsL, ftsQ, ftsW, ftsZ, murC, murD, murE, murF, murG, minC, minD, minE, mraY, mraW, mraZ, seqA and ddlB.

Examples of targeting sequences directed to the translation initiation region in an mRNA transcribed from a dic gene selected from the group consisting of dicA, dicB, dicC and dicF include those presented herein as SEQ ID NO:45 (*E. coli* dicF), SEQ ID NO:48 (*E. coli* dicA), SEQ ID NO:49 (*E. coli* dicB), SEQ ID NO:50 (*E. coli* dicC); and SEQ ID NO:61 (*S. thyphi.* dicA). In one embodiment, the targeting sequence has the sequence presented as SEQ ID NO:45, and the antisense oligomer is a morpholino oligomer.

Examples of targeting sequences directed to the translation initiation region in an mRNA transcribed from a dcw gene selected from the group consisting of ftsL, ftsW, ftsQ, ftsA, and ftsZ, and particularly directed to ftsZ mRNA, include those presented herein as: (a) SEQ ID NO:51 (*E. coli* ftsA), SEQ ID NO: 46 and SEQ ID NO:52 (*E. coli* ftsZ); (b) SEQ ID NO:62 (*Pseudomonas aeruginosa* ftsZ); (c) SEQ ID NO:65 (*Neisseria gonorrhoea* ftsZ); (d) SEQ ID NO:69 (*Staphylococcus aureus* ftsA) and SEQ ID NO:68 (*Staphylococcus aureus* ftsZ); (e) SEQ ID NO:74 (*Mycobacterium tuberculosis* ftsZ); (f) SEQ ID NO:80 (*Helicobacter pylori* ftsA) and SEQ ID NO:81 (*Helicobacter pylori* ftsZ); (g) SEQ ID NO:87 (*Streptococcus pneumoniae* ftsA) and SEQ ID NO:88 (*Streptococcus pneumoniae* ftsZ); (h) SEQ ID NO:92 (*Treponema pallidum* ftsA) and SEQ ID NO:93 (*Treponema pallidum* ftsZ); (i) SEQ ID NO:99 (*Chlamydia trachomatis* ftsW); and (j) SEQ ID NO:100 (*Bartonella henselae* ftsZ).

Examples of targeting sequences directed to the translation initiation region in an mRNA transcribed from a sec gene, and particularly directed to secA mRNA, include those presented herein as: SEQ ID NO:47 (*E. coli* secA), SEQ ID NO:67 (*Staph. aureus* secA), SEQ ID NO:79 (*H. pylori* secA), and SEQ ID NO:91 (*Treponema pallidum* secA). In one embodiment, the targeting sequence has the sequence presented as SEQ ID NO:47, and the antisense oligomer is a morpholino oligomer.

In further embodiments, particularly for treatment of infection by *Enterococcus faecium* or *Enterococcus faecalis*, the targeting sequence has a sequence selected from the group consisting of SEQ ID NO: 103 (*E. faecium* carbamate kinase); SEQ ID NO: 104 (*E. faecium* D-ala D-ala ligase); SEQ ID NO: 105 (*E. faecalis* topoisomerase); SEQ ID NO: 107 (*E. faecalis* repA); SEQ ID NO: 108 (*E. faecalis* alkyl hydrogen peroxide reductase); SEQ ID NO: 109 (*E. faecalis* thioredoxin reductase); SEQ ID NO: 110 (*E. faecalis* dihydrofolate reductase); SEQ ID NO: 111 (*E. faecalis* ftsA); and SEQ ID NO: 112 (*E. faecalis* cell wall enzyme). In selected embodiments, the oligomer is a morpholino oligomer, and the targeting sequence has a sequence selected from the group consisting of SEQ ID NO: 105 (*E. faecalis* topoisomerase); SEQ ID NO: 107 (*E. faecalis* repA);_SEQ ID NO: 108 (*E. faecalis* alkyl hydrogen peroxide reductase); and SEQ ID NO: 110 (*E. faecalis* dihydrofolate reductase).

In practicing the treatment method, the antisense oligomer is preferably administered in an amount and manner effective to result in a peak blood concentration of at least 200–400 nM antisense oligomer.

In selected embodiments, the oligomer may be administered by a topical route, for treating bacterial infections of the skin, or by inhalation, for treating a bacterial respiratory infection.

A further aspect of the invention is a method for treatment of a bacterial infection which includes the administration of a morpholino antisense oligomer to a subject, followed by administration of and antibiotic or other therapeutic treatment to the subject.

In still another aspect, the invention includes a livestock and poultry food composition containing a food grain supplemented with a subtherapeutic amount of an antibacterial compound of the type described above. Also contemplated is, in a method of feeding livestock and poultry with a food grain supplemented with subtherapeutic levels of an antibiotic, an improvement in which the food grain is supplemented with a subtherapeutic amount of an antibacterial oligonucleotide composition as described above.

In a further aspect, the invention provides a method of preparing a vaccine against a selected bacteria, comprising incubating the bacteria in the presence of an antisense morpholino-based antisense oligomer having (a) from 8 to 40 nucleotide subunits, including a targeting base sequence effective to hybridize to a translation initiation region in an mRNA transcribed from a gene of the selected bacteria, selected from the group consisting of zipA, sulA, secA, dicA, dicB, dicC, dicF, ftsA, ftsI, ftsN, ftsK, ftsL, ftsQ, ftsW, ftsZ, murC, murD, murE, murF, murG, minC, minD, minE, mraY, mraW, mraZ, seqA and ddlB; and (b) uncharged phosphorous-containing intersubunit linkages, as shown in FIGS. 2A–2D herein;

in an amount of oligomer effective to produce replication-crippled, morphologically abnormal bacterial cells. Accordingly, a human or animal subject can be vaccinated against a selected bacteria, by administering to the subject, replication-crippled, morphologically abnormal cells of the bacteria, prepared by incubating the bacteria in the presence of such a morpholino-based antisense oligomer.

These and other objects and features of the invention will become more fully apparent when the following detailed description is read in conjunction with the accompanying figures and examples.

DETAILED DESCRIPTION OF THE INVENTION

I. Definitions

Figure 1A:
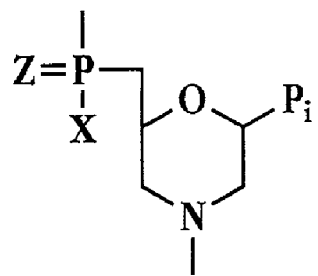
FIGS. 1A–D show several preferred morpholino-type subunits having 5-atom (A), six-atom (B) and seven-atom (C–D) linking groups suitable for forming polymers.

The terms below, as used herein, have the following meanings, unless indicated otherwise:

The term "cell cycle" refers to the regular sequence of events of cell growth and division through which dividing cells pass.

The term "polynucleotide" refers to a polymeric molecule having a backbone which supports bases capable of hydrogen bonding to typical polynucleotides, where the polymer backbone presents the bases in a manner to permit such hydrogen bonding in a sequence specific fashion between the polymeric molecule and a typical polynucleotide (e.g., single-stranded RNA, double-stranded RNA, single-stranded DNA or double-stranded DNA). "Polynucleotides" include polymers with nucleotides which are an N- or C-glycoside of a purine or pyrimidine base, and polymers containing non-standard nucleotide backbones, for example, backbones formed using phosphorodiamidate morpholino chemistry, polyamide linkages (e.g., peptide nucleic acids or PNAs) and other synthetic sequence-specific nucleic acid molecules.

The terms "antisense oligonucleotide" and "antisense oligomer" are used interchangeably and refer to a sequence of nucleotide bases and a subunit-to-subunit backbone that allows the antisense oligomer to hybridize to a target nucleic acid (e.g., RNA) sequence by Watson-Crick base pairing, to form a nucleic acid:oligomer heteroduplex within the target sequence. Typically, such an oligomer is from 8 to about 40 nucleotide subunits long, and more typically about 12 to 25 nucleotide subunits long. The oligomer may have exact sequence complementarity to the target sequence or near complementarity. Such an antisense oligomer may block or inhibit the formation of a bacterial cell division or cell cycle protein containing a given target sequence, e.g. by binding to a double-stranded or single-stranded portion of the nucleic acid target sequence, thereby inhibiting mRNA translation and/or protein synthesis, and is said to be "directed to" a sequence with which it specifically hybridizes.

An oligonucleotide or antisense oligomer "specifically hybridizes" to a target polynucleotide if the oligomer hybridizes to the target under physiological conditions, with a $T_m$ substantially greater than 37° C., preferably at least 50° C., and typically 60° C.–80° C. or higher. Such hybridization preferably corresponds to stringent hybridization conditions. At a given ionic strength and pH, the $T_m$ is the temperature at which 50% of a target sequence hybridizes to a complementary polynucleotide.

A "nuclease-resistant" oligomeric molecule (oligomer) is one whose backbone is not susceptible to nuclease cleavage of a phosphodiester bond. Exemplary nuclease resistant antisense oligomers are oligonucleotide analogs, such as phosphorothioate and phosphate-amine DNA (pnDNA), both of which have a charged backbone, and methyl-phosphonate, morpholino, and peptide nucleic acid (PNA) oligonucleotides, all of which have uncharged backbones.

A first sequence is an "antisense sequence" with respect to a second sequence if a polynucleotide with a first sequence specifically binds to, or specifically hybridizes with, a polynucleotide which has a second sequence, under physiological conditions.

Polynucleotides are described as "complementary" to one another when hybridization occurs in an antiparallel configuration between two single-stranded polynucleotides. A double-stranded polynucleotide can be "complementary" to another polynucleotide, if hybridization can occur between one of the strands of the first polynucleotide and the second. Complementarity (the degree that one polynucleotide is complementary with another) is quantifiable in terms of the proportion (i.e., the percentage) of bases in opposing strands that are expected to form hydrogen bonds with each other, according to generally accepted base-pairing rules.

A "subunit" of an oligonucleotide or oligonucleotide analog refers to one nucleotide (or nucleotide analog) unit of the oligomer. The term may refer to the nucleotide unit with or without the attached intersubunit linkage, although, when referring to a "charged subunit", the charge typically resides within the intersubunit linkage (e.g. a phosphate or phosphorothioate linkage).

A "morpholino oligomer" or "morpholino-based oligomer" refers to an oligonucleotide analog having a backbone which supports bases capable of hydrogen bonding to typical polynucleotides, wherein the oligomer contains, instead of a pentose sugar backbone moiety as found in nucleic acids, a morpholino backbone moiety, with coupling through the ring nitrogen. A typical "morpholino" oligonucleotide is composed of morpholino subunit structures of the form shown in FIGS. 1A–1D and 2A–2D, where (i) the structures are linked together by phosphorous-containing linkages, one to three atoms long, joining the morpholino nitrogen of one subunit to the 5' exocyclic carbon of an adjacent subunit, and (ii) each of Pi and Pj is a purine or pyrimidine base-pairing moiety effective to bind, by base-specific hydrogen bonding, to a base in a polynucleotide.

The term "PMO" refers to a phosphorodiamidate morpholino oligomer, as further described below. This preferred aspect of the invention is illustrated in FIG. 2B, where the two subunits are joined by a phosphorodiamidate linkage.

A "base-specific intracellular binding event involving a target RNA" refers to the specific binding of an oligomer to a target RNA sequence inside a cell. The base specificity of such binding is sequence specific. For example, a single-stranded polynucleotide can specifically bind to a single-stranded polynucleotide that is complementary in sequence.

A "nuclease-resistant heteroduplex" refers to a heteroduplex formed by the binding of an antisense oligomer to its complementary target, such that the heteroduplex is resistant to in vivo degradation by ubiquitous intracellular and extracellular nucleases.

Various exemplary bacteria may be referred to herein by the following abbreviations: *Escherichia coli* (*E. coli*), *Salmonella thyphimurium* (*S. thyphi.*), *Pseudomonas aeruginosa* (*P. aeruginosa*), *Vibrio cholera*, *Neisseria gonorrhoea* (*N. gonorrhoea*), *Staphylococcus aureus* (*Staph. aureus*), *Mycobacterium tuberculosis* (*M. tuberculosis*), *Helicobacter pylori* (*H. pylori*), *Streptococcus pneumoniae* (*Strep. pneumoniae*), *Treponema palladium* (*T. palladium*), *Chlamydia trachomatis* (*C. trachomatis*), *Bartonella henselae* (*B. henselae*), *Hemophilis influenza* (*H. influenza*) and *Shigella dysenterae* (*S. dysenterae*).

A "consensus sequence", relative to nucleic acid sequences of a particular group of organisms encoding a particular protein, includes, at each position, the nucleotide most commonly found at that position amongst the respective sequences corresponding to the group of organisms. A Gram-negative bacterial cell division or cell cycle protein-encoding nucleic acid consensus sequence is common to Gram-negative bacteria and generally not found in bacteria that are not Gram-negative.

The term "conserved", relative to cell division or cell cycle protein-encoding nucleic acid sequences, refers to a sequence which is common to or shared by a particular group of organisms (e.g., Gram-negative bacteria).

The term "broad spectrum bacterial sequence", with reference to antisense oligonucleotides directed to bacterial nucleic acid sequences which encode a particular cell division or cell cycle protein, refers to an oligonucleotide which is antisense to some segment of most, if not all, bacterial nucleic acid sequences which encode that cell division or cell cycle protein.

The term "narrow spectrum bacterial sequence" refers to an oligonucleotide of the invention which is antisense to a particular, but not most or all, bacterial nucleic acid sequences which encode a particular cell division or cell cycle protein. A "narrow spectrum bacterial sequence" may be specific to more than one type of bacteria, e.g., an antisense oligomer which is antisense to an *E. coli* and *S. thyphi* zipA nucleic acid sequence, but not the other known bacterial zipA nucleic acid sequences described herein, as exemplified by SEQ ID NO:57, or an antisense oligomer which is antisense to an *H. influenza* zipA nucleic acid sequence, but not the other known bacterial zipA mRNA sequences described herein, as exemplified by SEQ ID NO: 101.

The term "modulating expression", relative to antisense oligonucleotides, refers to the enhancement or reduction of the expression of a given protein as a result of interference with the transcription or translation of the nucleic acid which encodes that protein.

An "effective amount", relative to an antisense oligomer, refers to the amount of antisense oligomer administered to a mammalian subject, either as a single dose or as part of a series of doses, that is effective to inhibit a biological activity, e.g., expression of a selected target nucleic acid sequence.

"Treatment" of an individual or a cell is any type of intervention provided as a means to alter the natural course of the individual or cell. Treatment includes, but is not limited to, administration of e.g., a pharmaceutical composition, and may be performed either prophylactically, or subsequent to the initiation of a pathologic event or contact with an etiologic agent.

The term "improved therapeutic outcome", relative to a patient diagnosed as infected with a particular bacteria, refers to a slowing or diminution in the growth of the bacteria and/or a decrease in, or elimination of, detectable symptoms typically associated with infection by that particular bacteria.

II. Antisense Oligomers: Selection Criteria

Antisense compounds employed in the invention preferably meet several criteria of structure and properties, considered in the subsections below.

A. Base Sequence, Length and Duplex Stability

The antisense compound has a base sequence targeted against a selected bacterial nucleic acid target sequence. The region of complementarity with the target nucleic acid sequence may be as short as 10–12 bases, but is preferably 15–20 bases, and more preferably 17–18 bases, in order to achieve the requisite balance of cell entry and binding Tm, as discussed below. Preferably, the bacterial target sequence is one that spans the translational start codon for an mRNA which encodes a target bacterial protein.

The oligomer may be 100% complementary to the bacterial nucleic acid target sequence, or it may include mismatches, e.g., to accommodate variants, as long as the heteroduplex formed between the oligomer and bacterial nucleic acid target sequence is sufficiently stable to withstand the action of cellular nucleases and other modes of degradation which may occur in vivo. Mismatches, if present, are less destabilizing toward the end regions of the hybrid duplex than in the middle. The number of mismatches allowed will depend on the length of the oligomer, the percentage of G:C base pairs in the duplex, and the position of the mismatch(es) in the duplex, according to well understood principles of duplex stability. Although such an antisense oligomer is not necessarily 100% complementary to the bacterial nucleic acid target sequence, it is effective to stably and specifically bind to the target sequence such that a biological activity of the nucleic acid target, e.g., expression of bacterial protein(s) is modulated.

Oligomers as long as 40 bases may be suitable, where at least the minimum number of bases, e.g., 10–15 bases, are complementary to the target nucleic acid nucleic acid sequence. In general, however, facilitated or active uptake in cells is optimized at oligomer lengths less than about 30, preferably less than 25, and more preferably 20 or fewer bases. For PMO oligomers, describe further below, an optimum balance of binding stability and intake generally occurs at lengths of 17–18 bases.

The oligomer must form a stable hybrid duplex with the target sequence. Preferably, the oligomer is able to hybridize to the target nucleic acid sequence with a Tm substantially greater than the Tm of a duplex composed of a corresponding DNA and the same target nucleic acid sequence. The antisense oligomer will have a binding Tm, with respect to a complementary-sequence nucleic acid, of greater than body temperature and preferably greater than 50° C. Tm's in the range 60–80° C. or greater are preferred. The Tm of an antisense compound with respect to complementary-sequence nucleic acid may be measured by conventional methods, such as those described by Hames et al., *NUCLEIC ACID HYBRIDIZATION*, IRL Press, 1985, pp. 107–108. For purposes of transport, compounds that show high Tm (50° C. or greater) at a length of 15–20 bases or less will be preferred over those requiring 20+bases for high Tm values.

Increasing the ratio of C:G paired bases in the duplex is known to generally increase in the Tm of an oligomer compound. Studies in support of the invention suggest that maximizing the number of C bases in the antisense oligomer is particularly favorable.

B. Uptake by Cells

In order to achieve adequate intracellular levels, the antisense oligomer must be actively taken up by cells, meaning that the compound is taken up by facilitated or active transport, if administered in free (non-complexed) form, or is taken by an endocytotic mechanism if administered in complexed form.

When the antisense compound is administered in complexed form, the complexing agent typically is a polymer, e.g., a cationic lipid, polypeptide, or non-biological cationic polymer, having an opposite charge to a net charge on the antisense compound. Methods of forming complexes, including bilayer complexes, between anionic oligonucleotides and cationic lipid or other polymer components are well known. For example, the liposomal composition Lipofectin® (Felgner et al., 1987), containing the cationic lipid DOTMA (N-[1-(2,3-dioleyloxy)propyl]-N,N,N-trimethylammonium chloride) and the neutral phospholipid DOPE (dioleyl phosphatidyl ethanolamine), is widely used. After administration, the complex is taken up by cells through an endocytotic mechanism, typically involving particle encapsulation in endosomal bodies. The ability of the antisense agent to resist cellular nucleases promotes survival and ultimate delivery of the agent to the cell cytoplasm.

In the case where the agent is administered in free form, the agent should be substantially uncharged, meaning that a majority of its intersubunit linkages are uncharged at physiological pH. Experiments carried out in support of the invention indicate that a small number of net charges, e.g., 1–2 for a 15- to 20-mer oligomer, can in fact enhance cell uptake of certain oligomers with substantially uncharged backbones. The charges may be carried on the oligomer itself, e.g., in the backbone linkages, or may be terminal charged-group appendages. Preferably, the number of charged linkages is no more than one charged linkage per four uncharged linkages.

An oligomer may also contain both negatively and positively charged backbone linkages, as long as two opposite charges are in approximately equal number. Preferably, the oligomer does not include runs of more than 3–5 consecutive subunits of either charge. For example, the oligomer may have a given number of anionic linkages, e.g. phosphorothioate or N3'→P5' phosphoramidate linkages, and a comparable number of cationic linkages, such as N,N-diethylenediamine phosphoramidates (Dagle). The net charge is preferably neutral or at most 1–2 net charges per oligomer.

In addition to being substantially or fully uncharged, the antisense agent is preferably a substrate for a membrane transporter system (i.e. a membrane protein or proteins) capable of facilitating transport or actively transporting the oligomer across the cell membrane. This feature may be determined by one of a number of tests for oligomer interaction or cell uptake, as follows:

A first test assesses binding at cell surface receptors, by examining the ability of an oligomer compound to displace or be displaced by a selected charged oligomer, e.g., a phosphorothioate oligomer, on a cell surface. The cells are incubated with a given quantity of test oligomer, which is typically fluorescently labeled, at a final oligomer concentration of between about 10–300 nM. Shortly thereafter, e.g., 10–30 minutes (before significant internalization of the test oligomer can occur), the displacing compound is added, in incrementally increasing concentrations. If the test compound is able to bind to a cell surface receptor, the displacing compound will be observed to displace the test compound. If the displacing compound is shown to produce 50% displacement at a concentration of 10× the test compound concentration or less, the test compound is considered to bind at the same recognition site for the cell transport system as the displacing compound.

A second test measures cell transport, by examining the ability of the test compound to transport a labeled reporter, e.g., a fluorescence reporter, into cells. The cells are incubated in the presence of labeled test compound, added at a final concentration between about 10–300 nM. After incubation for 30–120 minutes, the cells are examined, e.g., by microscopy, for intracellular label. The presence of significant intracellular label is evidence that the test compound is transported by facilitated or active transport.

A third test relies on the ability of certain antisense compounds to effectively inhibit bacterial growth when targeted against a bacterial nucleic acid sequence which encodes a bacterial cell division or cell cycle protein. Studies carried out in support of the present invention show that the inhibition requires active or facilitated transport across bacterial cell membranes. The test compound is prepared with an antisense sequence that has been demonstrated to be effective in inhibiting bacterial growth. For example, SEQ ID. NO: 45 herein is a representative sequence against the *E. coli* DicF gene. The compound is added to the growing bacterial culture at increasing concentrations, typically between 10 nM and 1 mM. The ability to inhibit bacterial growth is measured from number of cell colonies at 24–72 hours after addition of the test compound. Compounds which can produce a 50% inhibition at a concentration of between about 100–500 nM or lower are considered to be good candidates for active transport.

C. mRNA Resistance to RNaseH

Two general mechanisms have been proposed to account for inhibition of expression by antisense oligonucleotides. (See e.g., Agrawal et al., 1990; Bonham et al., 1995; and Boudvillain et al., 1997). In the first, a heteroduplex formed between the oligonucleotide and mRNA is a substrate for RNaseH, leading to cleavage of the mRNA. Oligonucleotides belonging, or proposed to belong, to this class include phosphorothioates, phosphotriesters, and phosphodiesters (unmodified "natural" oligonucleotides). However, because such compounds would expose mRNA in an oligomer:RNA duplex structure to proteolysis by RNaseH, and therefore loss of duplex, they are suboptimal for use in the present invention. A second class of oligonucleotide analogs, termed "steric blockers" or, alternatively, "RNaseH inactive" or "RNaseH resistant", have not been observed to act as a substrate for RNaseH, and are believed to act by sterically blocking target RNA nucleocytoplasmic transport, splicing or translation. This class includes methylphosphonates (Toulme et al., 1996), morpholino oligonucleotides, peptide nucleic acids (PNA's), 2'-O-allyl or 2'-O-alkyl modified oligonucleotides (Bonham, 1995), and N3'→P5' phosphoramidates (Gee, 1998; Ding).

A test oligomer can be assayed for its ability to protect mRNA against RNaseH by forming an RNA:oligomer duplex with the test compound, then incubating the duplex with RNaseH under a standard assay conditions, as described in Stein et al. After exposure to RNaseH, the presence or absence of intact duplex can be monitored by gel electrophoresis or mass spectrometry.

III. Uncharged Oligonucleotide Analogs

Examples of uncharged linkages that may be used in oligonucleotide analogs of the invention are shown in FIGS. 3A–3G. As noted below, a small number of charged linkages, e.g. charged phosphoramidate or phosphorothioate, may also be incorporated into the oligomers. The uncharged linkages include carbonate (3A, R=O) and carbamate (3A, R=NH$_2$) linkages, (Mertes; Gait); alkyl phosphonate and phosphotriester linkages (3B, R=alkyl or -O-alkyl) (Miller; Lesnikowski); amide linkages (3C); sulfones (3D, R$_1$, R$_2$=CH$_2$) (Roughten); sulfonamides (3D, R$_1$=NH, R$_2$=CH$_2$ or vice versa) (McElroy); sulfamates (3D, R$_1$, R$_2$=NH) (Huie); and a thioformacetyl linkage (3E) (Matteucci; Cross). The latter is reported to have enhanced duplex and triplex stability with respect to phosphorothioate antisense compounds (Cross). Also reported are the 3'-methylene-N-methylhydroxyamino compounds of structure 3F (Vasseur). In FIGS. 3A–3G, B represents a purine or pyrimidine base-pairing moiety effective to bind, by base-specific hydrogen bonding, to a base in a polynucleotide, preferably selected from adenine, cytosine, guanine and uracil.

The linkages join nucleotide subunits, each consisting of a 5- or 6-membered ring supporting a base-pairing moiety effective to bind by Watson-Crick base pairing to a respective nucleotide base in the bacterial nucleic acid sequence. Although FIGS. 3A–F depict deoxyribose rings, subunits may also comprise, for example, substituted ribose rings, or morpholino rings (FIG. 3G), as described further below. Oligomeric ribonucleotides substituted at the 2'-oxygen show high RNA binding affinities and, in comparison to unsubstituted ribonucleotides, reduced sensitivity to endogenous nucleases. Methyl-substituted ribonucleotides are reported to provide greater binding affinity and cellular uptake than those having larger 2'-oxygen substituents (e.g. ethyl, propyl, allyl, or pentyl).

One preferred oligomer structure employs morpholino-based subunits bearing base-pairing moieties, joined by uncharged linkages as outlined above. Especially preferred is a substantially uncharged morpholino oligomer such as illustrated by the phosphorodiamidate-linked compound shown in FIG. 3G. Morpholino oligonucleotides, including antisense oligomers, are detailed, for example, in co-owned U.S. Pat. Nos. 5,698,685, 5,217,866, 5,142,047, 5,034,506, 5,166,315, 5,185,444, 5,521,063, and 5,506,337, all of which are expressly incorporated by reference herein. Desirable chemical properties of the morpholino-based subunits are the ability to be linked in a oligomeric form by stable, uncharged backbone linkages, the ability of the polymer so formed to hybridize with a complementary-base target nucleic acid, including target RNA, with high Tm, even with oligomers as short as 10–14 bases, the ability of the oligomer to be actively transported into mammalian cells, and the ability of the oligomer:RNA heteroduplex to resist RNAse degradation.

Exemplary backbone structures for antisense oligonucleotides of the invention include the morpholino subunit types shown in FIGS. 1A–D, each linked by an uncharged, phosphorous-containing subunit linkage. In these figures, and in FIGS. 2A–D, the X moiety pendant from the phosphorous may be any of the following: fluorine; an alkyl or substituted alkyl; an alkoxy or substituted alkoxy; a thioalkoxy or substituted thioalkoxy; or, an unsubstituted, monosubstituted, or disubstituted nitrogen, including cyclic structures. Alkyl, alkoxy and thioalkoxy preferably include 1–6 carbon atoms, and more preferably 1–4 carbon atoms. Monosubstituted or disubstituted nitrogen preferably refers to lower alkyl substitution, and the cyclic structures are preferably 5- to 7-membered nitrogen heterocycles optionally containing 1–2 additional heteroatoms selected from oxygen, nitrogen, and sulfur. Z is sulfur or oxygen, and is preferably oxygen.

Figure 2A:
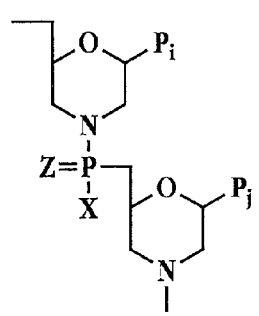
FIGS. 2A–D show the repeating subunit segment of exemplary morpholino oligonucleotides, designated A through D, constructed using subunits A–D, respectively, of FIG. 1.
Figure 2B:
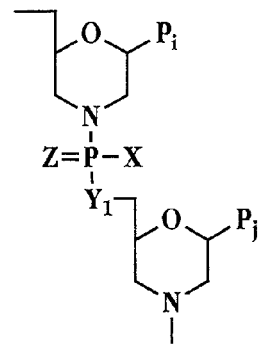

FIG. 1A shows a phosphorous-containing linkage which forms the five atom repeating-unit backbone shown in FIG. 2A, where the morpholino rings are linked by a 1-atom phosphoamide linkage.

Figure 1B:
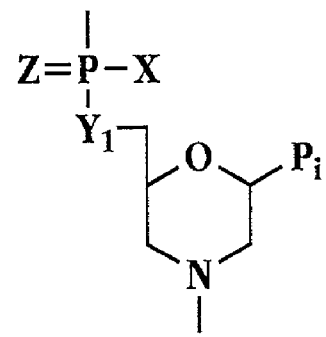

Subunit B in FIG. 1B is designed for 6-atom repeating-unit backbones, as shown in FIG. 2B. In FIG. 1B, the atom Y linking the 5' morpholino carbon to the phosphorous group may be sulfur, nitrogen, carbon or, preferably, oxygen. The X and Z moieties are as defined above. Particularly preferred morpholino oligonucleotides include those composed of morpholino subunit structures of the form shown in FIG. 2B, where X=NH$_2$ or N(CH$_3$)$_2$, Y=O, and Z=O.

Figure 1C:
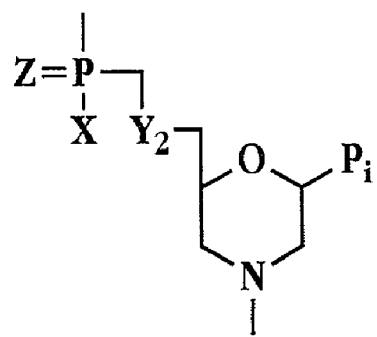
Figure 1D:
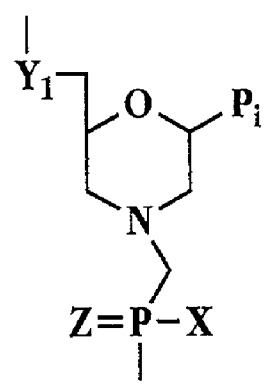
Figure 2C:
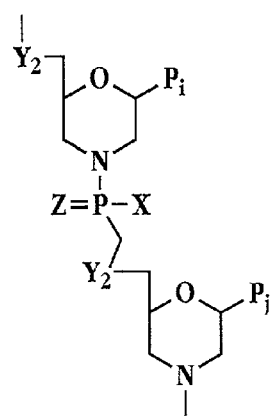
Figure 2D:
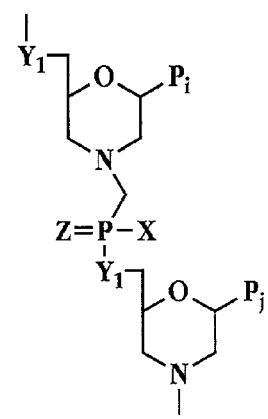
Figure 3A:
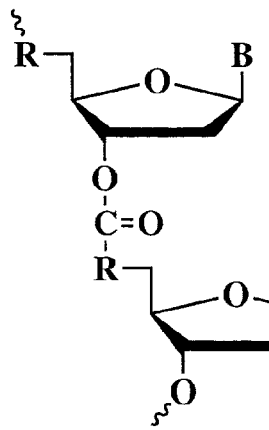
FIGS. 3A–3G show examples of uncharged linkage types in oligonucleotide analogs.
Figure 3B:
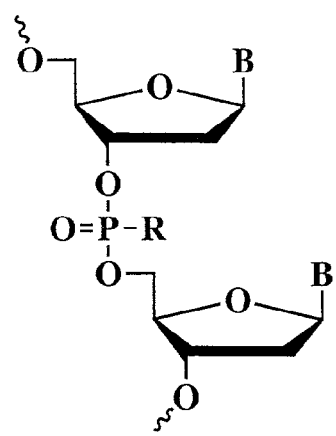
Figure 3C:
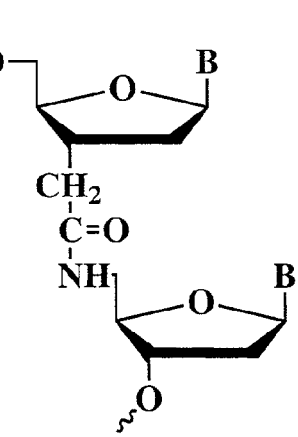
Figure 3D:
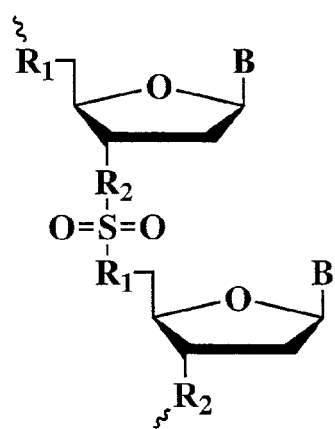
Figure 3E:
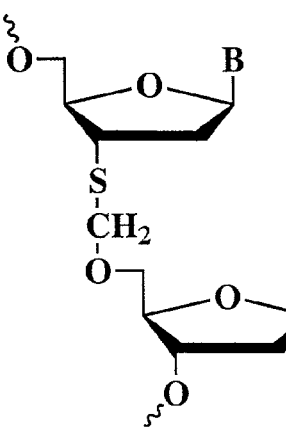
Figure 3F:
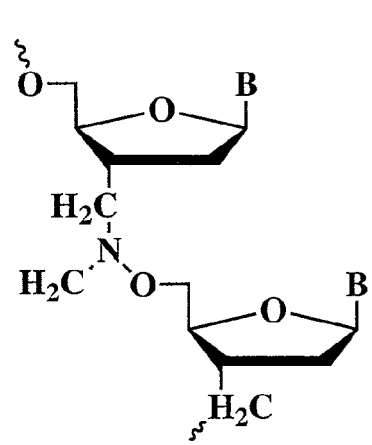
Figure 3G:
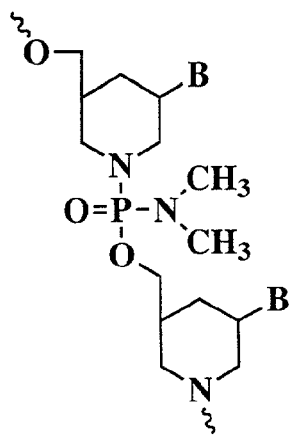

Subunits C–D in FIGS. 1C–D are designed for 7-atom unit-length backbones as shown for structures in FIGS. 2C and D. In Structure C, the X moiety is as in Structure B, and the moiety Y may be methylene, sulfur, or preferably oxygen. In Structure D, the X and Y moieties are as in Structure B. In all subunits depicted in FIGS. 1 and 2, each Pi and Pj is a purine or pyrimidine base-pairing moiety effective to bind, by base-specific hydrogen bonding, to a base in a polynucleotide, and is preferably selected from adenine, cytosine, guanine and uracil.

As noted above, the substantially uncharged oligomer may advantageously include a limited number of charged linkages, e.g. up to about 1 per every 5 uncharged linkages. In the case of the morpholino oligomers, such a charged linkage may be a linkage as represented by any of FIGS. 2A–D, preferably FIG. 2B, where X is oxide (-O$^-$) or sulfide (-S$^-$).

The antisense compounds of the invention can be synthesized by stepwise solid-phase synthesis, employing methods detailed in the references cited above. The sequence of subunit additions will be determined by the selected base sequence. In some cases, it may be desirable to add additional chemical moieties to the oligomer compounds, e.g. to enhance the pharmacokinetics of the compound or to facilitate capture or detection of the compound. Such a moiety may be covalently attached, typically to the 5'- or 3'-end of the oligomer, according to standard synthesis methods. For example, addition of a polyethyleneglycol moiety or other hydrophilic polymer, e.g., one having 10–100 polymer subunits, may be useful in enhancing solubility. One or more charged groups, e.g., anionic charged groups such as an organic acid, may enhance cell uptake. A reporter moiety, such as fluorescein or a radiolabeled group, may be attached for purposes of detection. Alternatively, the reporter label attached to the oligomer may be a ligand, such as an antigen or biotin, capable of binding a labeled antibody or streptavidin. In selecting a moiety for attachment or modification of an oligomer antisense, it is generally of course desirable to select chemical compounds of groups that are biocompatible and likely to be tolerated by a subject without undesirable side effects.

IV. Exemplary Bacterial Targets

*Escherichia coli* (*E. coli*) is a Gram negative bacteria that is part of the normal flora of the gastrointestinal tract. There are hundreds of strains of *E. coli*, most of which are harmless and live in the gastrointestinal tract of healthy humans and animals. Currently, there are four recognized classes of enterovirulent *E. coli* (the "EEC group") that cause gastroenteritis in humans. Among these are the enteropathogenic (EPEC) strains and those whose virulence mechanism is related to the excretion of typical *E. coli* enterotoxins. Such strains of *E. coli* can cause various diseases including those associated with infection of the gastrointestinal tract and urinary tract, septicemia, pneumonia, and meningitis. Antibiotics are not effective against some strains and do not necessarily prevent recurrence of infection.

For example, *E. coli* strain O157:H7 is estimated to cause 10,000 to 20,000 cases of infection in the United States annually (Federal Centers for Disease Control and Prevention). Hemorrhagic colitis is the name of the acute disease caused by *E. coli* O157:H7. Preschool children and the elderly are at the greatest risk of serious complications. *E. coli* strain O157:H7 was recently reported as the cause the death of four children who ate under cooked hamburgers from a fast-food restaurant in the Pacific Northwest. (See, e.g., Jackson et al., *Epidemiol. Infect.* 120(1):17–20, 1998.)

Exemplary sequences for enterovirulent *E. coli* strains include GenBank Accession Numbers AB011549, X97542, AF074613, Y11275 and AJ007716.

*Salmonella thyphimurium*, are Gram negative bacteria which cause various conditions that range clinically from localized gastrointestinal infections, gastroenterits (diarrhea, abdominal cramps, and fever) to enteric fevers (including typhoid fever) which are serious systemic illnesses. *Salmonella* infection also causes substantial losses of livestock.

Typical of Gram-negative bacilli, the cell wall of *Salmonella* spp. contains a complex lipopolysaccharide (LPS) structure that is liberated upon lysis of the cell and may function as an endotoxin, which contributes to the virulence of the organism.

Contaminated food is the major mode of transmission for non-typhoidal *salmonella* infection, due to the fact that *Salmonella* survive in meats and animal products that are not thoroughly cooked. The most common animal sources are chickens, turkeys, pigs, and cows; in addition to numerous other domestic and wild animals. The epidemiology of typhoid fever and other enteric fevers caused by *Salmonella* spp. is associated with water contaminated with human feces.

Vaccines are available for typhoid fever and are partially effective; however, no vaccines are available for non-typhoidal *Salmonella* infection. Non-typhoidal salmonellosis is controlled by hygienic slaughtering practices and thorough cooking and refrigeration of food. Antibiotics are indicated for systemic disease, and Ampicillin has been used with some success. However, in patients under treatment with excessive amounts of antibiotics; patients under treatment with immunsuppressive drugs; following gastric surgery; and in patients with hemolytic anemia, leukemia, lymphoma, or AIDS, *Salmonella* infection remains a medical problem.

*Pseudomonas* spp. are motile, Gram-negative rods which are clinically important because they are resistant to most antibiotics, and are a major cause of hospital acquired (nosocomial) infections. Infection is most common in: immunocompromised individuals, burn victims, individuals on respirators, individuals with indwelling catheters, IV narcotic users and individual with chronic pulmonary disease (e.g., cystic fibrosis). Although infection is rare in healthy individuals, it can occur at many sites and lead to urinary tract infections, sepsis, pneumonia, pharyngitis, and numerous other problems, and treatment often fails with greater significant mortality.

*Vibrio cholera* is a Gram negative rod which infects humans and causes cholera, a disease spread by poor sanitation, resulting in contaminated water supplies. *Vibrio cholerae* can colonize the human small intestine, where it produces a toxin that disrupts ion transport across the mucosa, causing diarrhea and water loss. Individuals infected with *Vibrio cholerae* require rehydration either intravenously or orally with a solution containing electrolytes. The illness is generally self-limiting, however, death can occur from dehydration and loss of essential electrolytes. Antibiotics such as tetracycline have been demonstrated to shorten the course of the illness, and oral vaccines are currently under development.

*Neisseria gonorrhoea* is a Gram negative coccus, which is the causative agent of the common sexually transmitted disease, gonorrhea. *Neisseria gonorrhoea* can vary its surface antigens, preventing development of immunity to reinfection. Nearly 750,000 cases of gonorrhea are reported annually in the United States, with an estimated 750,000 additional unreported cases annually, mostly among teenagers and young adults. Ampicillin, amoxicillin, or some type of penicillin used to be recommended for the treatment of gonorrhea. However, the incidence of penicillin-resistant gonorrhea is increasing, and new antibiotics given by injection, e.g., ceftriaxone or spectinomycin, are now used to treat most gonococcal infections.

*Staphylococcus aureus* is a Gram positive coccus which normally colonizes the human nose and is sometimes found on the skin. *Staphylococcus* can cause bloodstream infections, pneumonia, and surgical-site infections in the hospital setting (i.e., nosocomial infections). *Staph. aureus* can cause severe food poisoning, and many strains grow in food and produce exotoxins. *Staphylococcus* resistance to common antibiotics, e.g., vancomycin, has emerged in the United States and abroad as a major public health challenge both in community and hospital settings. Recently a vancomycin-resistant *Staph. aureus* isolate has also been identified in Japan.

*Mycobacterium tuberculosis* is a Gram positive bacterium which is the causative agent of tuberculosis, a sometimes crippling and deadly disease. Tuberculosis is on the rise and globally, and the leading cause of death from a single infectious disease (with a current death rate of three million people per year). It can affect several organs of the human body, including the brain, the kidneys and the bones, however, tuberculosis most commonly affects the lungs.

In the United States, approximately ten million individuals are infected with *Mycobacterium tuberculosis*, as indicated by positive skin tests, with approximately 26,000 new cases of active disease each year. The increase in tuberculosis (TB) cases has been associated with HIV/AIDS; homelessness, drug abuse and immigration of persons with active infections. Current treatment programs for drug-susceptible TB involve taking two or four drugs (e.g., isoniazid, rifampin, pyrazinamide, ethambutol or streptomycin), for a period of from six to nine months, because all of the TB germs cannot be destroyed by a single drug. In addition, the observation of drug-resistant and multiple drug resistant strains of *Mycobacterium tuberculosis* is on the rise.

*Helicobacter pylori* (*H. pylori*) is a micro-aerophilic, Gram negative, slow-growing, flagellated organism with a spiral or S-shaped morphology which infects the lining of the stomach. *H. pylori* is a human gastric pathogen associated with chronic superficial gastritis, peptic ulcer disease, and chronic atrophic gastritis leading to gastric adenocarcinoma. *H. pylori* is one of the most common chronic bacterial infections in humans and is found in over 90% of patients with active gastritis. Current treatment includes triple drug therapy with bismuth, metronidazole, and either tetracycline or amoxicillin which eradicates *H. pylori* in most cases. Problems with triple therapy include patient compliance, side effects, and metronidazole resistance. Alternate regimens of dual therapy which show promise are amoxicillin plus metronidazole or omeprazole plus amoxicillin.

*Streptococcus pneumoniae* is a Gram positive coccus and one of the most common causes of bacterial pneumonia as well as middle ear infections (otitis media) and meningitis. Each year in the United States, pneumococcal diseases account for approximately 50,000 cases of bacteremia; 3,000 cases of meningitis; 100,000–135,000 hospitalizations; and 7 million cases of otitis media. Pneumococcal infection causing an estimated 40,000 deaths annually in the United States. Children less than 2 years of age, adults over 65 years of age and persons of any age with underlying medical conditions, including, e.g., congestive heart disease, diabetes, emphysema, liver disease, sickle cell, HIV, and those living in special environments, e.g., nursing homes and long-term care facilities, at highest risk for infection.

Drug-resistant *S. pneumoniae* strains have become common in the United States, with many penicillin-resistant pneumococci also resistant to other antimicrobial drugs, such as erythromycin or trimethoprim-sulfamethoxazole.

*Treponema palladium* is a spirochete which causes syphilis. *T. pallidum* is exclusively a pathogen which causes syphilis, yaws and non-venereal endemic syphilis or pinta. *Treponema pallidum* cannot be grown in vitro and does replicate in the absence of mammalian cells. The initial infection causes an ulcer at the site of infection; however, the bacteria move throughout the body, damaging many organs over time. In its late stages, untreated syphilis, although not contagious, can cause serious heart abnormalities, mental disorders, blindness, other neurologic problems, and death.

Syphilis is usually treated with penicillin, administered by injection. Other antibiotics are available for patients allergic to penicillin, or who do not respond to the usual doses of penicillin. In all stages of syphilis, proper treatment will cure the disease, but in late syphilis, damage already done to body organs cannot be reversed.

*Chlamydia trachomatis* is the most common bacterial sexually transmitted disease in the United States and it is estimated that 4 million new cases occur each year. the highest rates of infection are in 15 to 19 year olds. *Chlamydia* is a major cause of non-gonococcal urethritis (NGU), cervicitis, bacterial vaginitis, and pelvic inflammatory disease (PID). *Chlamydia* infections may have very mild symptoms or no symptoms at all, however, if left untreated *Chlamydia* infections can lead to serious damage to the reproductive organs, particularly in women. Antibiotics such as azithromycin, erythromycin, ofloxacin, amoxicillin or doxycycline are typically prescribed to treat *Chlamydia* infection.

*Bartonella henselae*. Cat Scratch Fever (CSF) or cat scratch disease (CSD), is a disease of humans acquired through exposure to cats, caused by a Gram negative rod originally named *Rochalimaea henselae*, and currently known as *Bartonella henselae*. Symptoms include fever and swollen lymph nodes and CSF is generally a relatively benign, self-limiting disease in people, however, infection with *Bartonelia henselae* can produce distinct clinical symptoms in immunocompromised people, including, acute febrile illness with bacteremia, bacillary angiomatosis, peliosis hepatis, bacillary splenitis, and other chronic disease manifestations such as AIDS encephalopathy.

The disease is treated with antibiotics, such as doxycycline, erythromycin, rifampin, penicillin, gentamycin, ceftriaxone, ciprofloxacin, and azithromycin.

*Haemophilus influenzae* (*H. influenza*) is a family of Gram negative bacteria; six types of which are known, with most *H. influenza*-related disease caused by type B, or "HIB". Until a vaccine for HIB was developed, HIB was a common causes of otitis media, sinus infections, bronchitis, the most common cause of meningitis, and a frequent culprit in cases of pneumonia, septic arthritis (joint infections), cellulitis (infections of soft tissues), and pericarditis (infections of the membrane surrounding the heart). The *H. influenza* type B bacterium is widespread in humans and usually lives in the throat and nose without causing illness. Unvaccinated children under age 5 are at risk for HIB disease. Meningitis and other serious infections caused by *H. influenza* infection can lead to brain damage or death.

*Shigella dysenteriae* (*Shigella* dys.) is a Gram negative rod which causes dysentary. In the colon, the bacteria enter mucosal cells and divide within mucosal cells, resulting in an extensive inflammatory response. *Shigella* infection can cause severe diarrhea which may lead to dehydration and can be dangerous for the very young, very old or chronically ill. *Shigella* dys. forms a potent toxin (shiga toxin), which is cytotoxic, enterotoxic, neurotoxic and acts as a inhibitor of protein synthesis. Resistance to antibiotics such as ampicillin and TMP-SMX has developed, however, treatment with newer, more expensive antibiotics such as ciprofloxacin, norfloxacin and enoxacin, remains effective.

*Listeria* is a genus of Gram-positive, motile bacteria found in human and animal feces. *Listeria monocytogenes* causes such diseases as meningoencephalitis and meningitis; In cattle and sheep, listeria infection causes encephalitis and spontaneous abortion.

Veterinary applications. A healthy microflora in the gastro-intestinal tract of livestock is of vital importance for health and corresponding production of associated food products. As with humans, the gastrointestinal tract of a healthy animal contains numerous types of bacteria (i.e., *E. coli, Pseudomonas aeruginosa* and *Salmonella* spp.), which live in ecological balance with one another. This balance may be disturbed by a change in diet, stress, or in response to antibiotic or other therapeutic treatment, resulting in bacterial diseases in the animals generally caused by bacteria such as *Salmonella, Campylobacter, Enterococci, Tularemia* and *E. coli*. Bacterial infection in these animals often necessitates therapeutic intervention, which has treatment costs as well being frequently associated with a decrease in productivity.

As a result, livestock are routinely treated with antibiotics to maintain the balance of flora in the gastrointestinal tract. The disadvantages of this approach are the development of antibiotic resistant bacteria and the carry over of such antibiotics into resulting food products for human consumption.

V. Cell Division and Cell Cycle Genes and Proteins

The antisense oligomers of the invention are designed to hybridize to a region of a nucleic acid sequence which encodes a bacterial cell division or cell cycle protein, under physiological conditions with a Tm substantially greater than 37° C., e.g., at least 50° C. and preferably 60° C.–80° C. Alternatively, the antisense oligomer may be targeted to a bacterial tRNA, preferably met-tRNA. The oligomer is designed to have high-binding affinity to the target nucleic acid sequence and may be 100% complementary to the cell division or cell cycle-encoding nucleic acid target sequence, or may include mismatches, as further described above.

In various aspects, the invention provides an antisense oligomer which is a nucleic acid sequence effective to stably and specifically bind to a nucleic acid target sequence which encodes a bacterial cell division or cell cycle protein including the following: (1) a sequence specific to a particular strain of a given species of bacteria, such as a strain of *E. coli* associated with food poisoning, e.g., O157:H7 (see Table 1 below); (2) a sequence common to two or more species of bacteria; (3) a sequence common to two related genera of bacteria (i.e., bacterial genera of similar phylogenetic origin); (4) a sequence generally conserved among Gram-negative bacteria; (5) generally conserved among Gram-positive bacteria; or (6) a consensus sequence for bacterial cell division or cell cycle protein-encoding nucleic acid sequences in general.

In general, the target for modulation of gene expression using the antisense methods of the present invention comprises an mRNA expressed during active bacterial growth or replication, such as an mRNA sequence transcribed from a gene of the cell division and cell wall synthesis (dcw) gene cluster, including, but not limited to, zipA, sulA, secA, dicA, dicB, dicC, dicF, ftsA, ftsI, ftsN, ftsK, ftsL, ftsQ, ftsW, ftsZ, murC, murD, murE, murF, murG, minC, minD, minE, mraY, mraW, mraZ, seqA and ddlB. See Bramhill, D., *Annu. Rev. Cell Dev. Biol.* 13:395–424, 1997, and Donachie, W. D., *Annu. Rev. Microbiol.* 47:199–230, 1993, both of which are expressly incorporated by reference herein, for general reviews of bacterial cell division and the cell cycle of *E. coli*, respectively.

Cell division in *E. coli* involves coordinated invagination of all 3 layers of the cell envelope (cytoplasmic membrane, rigid peptidoglycan layer and outer membrane). Constriction of the septum severs the cell into 2 compartments and segregates the replicated DNA. At least 9 essential gene products participate in this process: ftsZ, ftsA, ftsQ, ftsL, ftsI, ftsN, ftsK, ftsW and zipA (Hale, C. A., and DeBoer, P. A., *J. Bacteriol.* 181(1):167–176, 1999).

FtsZ, one of the earliest essential cell division genes in *E. coli*, is a soluble, tubulin-like GTPase that forms a membrane-associated ring at the division site of bacterial cells. The ring is thought to drive cell constriction, and appears to affect cell wall invagination. FtsZ binds directly to a novel integral inner membrane protein in *E. coli* called zipA, an essential component of the septal ring structure that mediates cell division in *E. coli* (Lutkenhaus, J. and Addinall, S. G., *Ann. Rev. Biochem.* 66:93–116, 1997).

For normal cell division, the ftsZ gene is transcribed from a number of promoters that are located within the proximal upstream genes, ddlB, ftsQ, and ftsA (Smith, R. W. et al., *J. Bacteriol.* 175(9):2788–91, 1993). A 490-bp DNA segment spanning the junction between the ftsA and ftsZ genes was shown to inhibit cell division when present in high copy number (Dewar, S. J. and Donachie, W. D., *J. Bacteriol.* 175(21):7097–101, 1993).

A conserved cell division inhibitor, MinCD, consists of MinC, an inhibitor of cell division, which in conjunction with MinD prevents division at the cell poles. A further protein, designated MinE in *E. coli*, plays a role in the control of MinCD action. (Marston, A. L. et al., *Genes Dev.* 12(21):3419–3430, 1998; Pogliano, J. et al., *J. Bacteriol.* 180(13):3486–90, 1998).

A promoter designated Pmra was found to be required for expression of the first nine genes of the mra cluster in *E. coli*: mraZ (orfC), mraW (orfB), ftsL (mraR), ftsI, murE, murF, mraY, murD, and ftsW (Mengin-Lecreulx, D. et al., *J. Bacteriol.* 180(17):4406–4412, 1998).

The murD, murE, murF and murC genes are involved in cell wall formation, as described in Lu, M. et al., Cell 77: 413–426, 1994; Tao, J. S. and Ishiguro, E. E., *Can. J. Microbiol.* 35:1051–1054, 1989; Menguin-Lecreulx, D. and Van Heijenoort, J., *Nucleic Acids Res.* 18:183–183, 1990; Ikeda, M. et al., *Nucleic Acids Res.* 18: 1058–1058, 1990; and Ikeda, M. et al., *Nucleic Acids Res.* 18: 4014–4014, 1990.

The SecA gene is involved in protein export in *E. coli*, where it has a central role in coupling the hydrolysis of ATP to the transfer of pre-secretory periplasmic and outer membrane proteins across the membrane. SecA is one of seven secretory proteins (secA-secF and secY) that comprise the prokaryotic protein translocation apparatus.

The SeqA gene is a negative modulator of replication initiation in *E. coli* (Lu, M. et al., *Cell* 77:413–426, 1994).

The dicB operon of *E. coli*, shown to code for a small protein which inhibits cell division, expresses a second inhibitor, dicF. A 53-nucleotide RNA molecule encoded by the dicF gene has been shown to block cell division in *E. coli* by inhibiting the translation of ftsZ mRNA, indicating that dicF functions by encoding antisense RNA. (See, e.g., Tetart, F. and Bouche, J. P., *Mol. Microbiol.* 6(5):615–620, 1992; Faubladier, M. et al., *J. Mol. Biol.* 212(3):461–471, 1990; Delihas, N., *Mol. Microbiol.* 15(3):411–414, 1995.) The dicA gene has been shown to encode a repressor protein which acts on the division inhibition gene dicB (Bejar, S. et al., *Nucleic Acids Res.* 14(17):6821–33, 1986).

The SulA gene is involved in sulfonamide resistance. DHPS (SulS) catalyzes the formation of the immediate precursor of folic acid and is also implicated in resistance to sulfonamide (Lopez, P. et al., *J. Bacteriol.* 169(9):4320–4326, 1987). The *E. coli* and *S. typhimurium* sulA genes encode an inhibitor of cell division. (See, e.g., Freudl, R. et al., *Gene* 52:31–40, 1987.)

GenBank references for exemplary bacterial sequences which contain the coding sequence for various cell division and cell cycle genes are presented in Table 1 below.

the teachings of the present invention. Preferably, the targeting sequence of the antisense oligomer is complementary to a bacterial gene in the cell division and cell wall synthesis

TABLE 1

Exemplary Bacterial Cell Division and Cell Cycle Nucleic Acid Sequences

| Organism | GenBank Reference | Protein(s) | SEQ ID NO |
|---|---|---|---|
| Escherichia coli | X07465 | dicA, dicB, dicC and dicF | 1 |
| Escherichia coli | X55034 | FtsA, ftsQ, ftsW, ftsZ, mraY, murC, murD, murE, murF, murG, secA | 2 |
| Escherichia coli | D90751 | minC, minD | 3 |
| Escherichia coli | D90707 | seqA | 4 |
| Escherichia coli | U74650 | zipA | 5 |
| Escherichia coli | J01654 | sulA | 6 |
| Escherichia coli (0157:H7) | AB011549 | portion of entire genome | 7 |
| Escherichia coli (0157:H7) | X97542 | portion of entire genome | 8 |
| Escherichia coli (0157:H7) | AF074613 | portion of entire genome | 9 |
| Escherichia coli (0157:H7) | Y11275 | portion of entire genome | 10 |
| Escherichia coli (0157:H7) | AJ007716 | portion of entire genome | 11 |
| Salmonella thyphimurium | M21450 | zipA | 12 |
| Salmonella thyphimurium | M16324 | sulA | 13 |
| Salmonella thyphimurium | AF001386 | dicA | 14 |
| Pseudomonas aeruginosa | U19797 | ftsZ | 15 |
| Vibrio cholera | AF141867 | murE | 16 |
| Vibrio cholera | X56018 | sulA | 17 |
| Neisseria gonorrhoea | U76537 | ftsZ | 18 |
| Staphylococcus aureus | Z84573 | sulA | 19 |
| Staphylococcus aureus | U97062 | secA | 20 |
| Staphylococcus aureus | U94706 | ftsZ | 21 |
| Staphylococcus aureus | U94706 | ftsA | 22 |
| Staphylococcus aureus | AF034076 | murC | 23 |
| Staphylococcus aureus | U94706 | murD | 24 |
| Staphylococcus aureus | Y14370 | murE | 25 |
| Staphylococcus aureus | U94706 | mraY | 26 |
| Mycobacterium tuberculosis | Z95388 | ftsZ, murC, murD, murE, mraY | 27 |
| Helicobacter pylori | AE001503 | seqA | 28 |
| Helicobacter pylori | AE001520 | ftsA, ftsZ | 29 |
| Helicobacter pylori | AE001489 | murC | 30 |
| Helicobacter pylori | AE001479 | murD, mraY | 31 |
| Helicobacter pylori | AE00156 | murE | 32 |
| Streptococcus pneumoniae | U16156 | sulA | 33 |
| Streptococcus pneumoniae | AF068901 | ftsA, ftsZ | 34 |
| Streptococcus pneumoniae | AF068902 | murD | 35 |
| Streptococcus pneumoniae | AF068903 | mraY | 36 |
| Treponema palladium | AE001217 | seqA, ftsA, ftsZ | 37 |
| Treponema palladium | AE001213 | murC | 38 |
| Treponema palladium | AE001259 | murD | 39 |
| Treponema palladium | AE001214 | mraY | 40 |
| Chlamydia trachomatis | AE001348 | murC, murD, mraY, ftsW | 41 |
| Bartonella henselae | AF061746.1 | ftsZ | 42 |
| Hemophilis influenza | U32790 | zipA | 43 |
| Hemophilis influenza | U32793 | mraY | 44 |

VI. Exemplary Oligomers Antisense to Cell Division and Cell Cycle Nucleic Acids

In various aspects, the invention provides an antisense oligomer which comprises a nucleic acid sequence effective to stably and specifically bind to a target sequence which spans the translational start for an mRNA which encodes a protein that: (1) is unique to a particular strain of a given species or strain of bacteria, i.e., E. coli strain 0157:H7; (2) shares homology among two or more species of bacteria; (3) is common to (shares homology among) Gram-negative bacteria; (4) is common to (shares homology among) Gram-positive bacteria; or (5) is common to (shares homology among) most if not all bacteria.

The GenBank references for various bacterial cell division and cell cycle nucleic acid sequences, such as those exemplified in Table 1, above, may be used by one of skill in the art to design an antisense oligomer for a given cell division or cell cycle protein/bacteria combination, based on gene cluster, including, but not limited to, zipA, sulA, secA, dicA, dicB, dicC, dicF, ftsA, ftsI, ftsN, ftsK, ftsL, ftsQ, ftsW, ftsZ, murC, murD, murE, murF, murG, minC, minD, minE, mraY, mraW, mraZ, seqA and ddlB. In general, such an antisense oligonucleotide is designed as follows: (1) the location of the translational start codon is identified for a given bacterial cell division or cell cycle protein of interest; (2) a sequence of from about 12 to 25 nucleotides is selected which includes about 3 to 9 nucleotides 5' of the start for the chosen protein together with the first 12 to 18 nucleotides of the coding sequence; and (3) an antisense oligomer is designed based on the selected sequence.

Once a bacterial nucleic acid sequence is selected, the sequence may be compared to other bacterial sequences using a computer program such as BLAST (Basic Local Alignment Search Tool). A BLAST analysis may be carried out to compare any given sequence to sequences in public databases to determine if the selected sequence is homologous to other sequences in the database (see, for example, SEQ ID NO: 58 above). In carrying out the BLAST analyses described herein, the BLAST search program found at http://www.ncbi.nlm.nih.gov/BLAST/was employed and "BLASTN" searches carried out which compare a nucleotide query sequence against a nucleotide sequence database. Version 2.0.10 of BLASTN (Aug. 26, 1999) was used to search Non-redundant GenBank+EMBL+DDBJ+PDB sequences. (See, e.g., Altschul, S. et al., *Nucleic Acids Res.* 25:3389–3402, 1997).

In such analyses, the BLASTN program is preferred for searching nucleic acid sequences against a nucleic acid sequence database and the BLASTX program is preferred for searching nucleic acid sequences that have been translated in all reading frames against amino acid sequences in the GenBank Protein Sequence database and other public databases. Both BLASTN and BLASTX utilize the BLOSUM-62 matrix and are run using default parameters with an open gap penalty of 11.0, and an extended gap penalty of 1.0. (See Altschul et al., 1997, cited above.)

The results of such sequence comparisons may be reported in terms of "percent identity" or "percent homology" between the two sequences. The term "percent identity" refers to the level of identity between two nucleic acid or amino acid sequences, as determined by a defined algorithm, and accordingly a homologue of a given sequence has at least about 70% or 80%, preferably about 90, 95 or 98% sequence identity over a length of the given sequence. It will be understood that as used herein the term "70% homology" means the same thing as 70% sequence identity.

Exemplary bacterial cell division or cell cycle nucleic acid sequences which are targets for antisense regulation and corresponding exemplary antisense oligomers for targeting such sequences are provided in Tables 2A–C and 3, below. In each case, the antisense oligomer to the indicated target was designed based on the nucleic acid sequence found at the indicated location of the given GenBank Accession Number. For example, an exemplary antisense oligomer to *E. coli* dicF has the sequence presented as SEQ ID NO:45 (Table 2A) and was designed based on (i.e. is antisense to) the nucleic acid sequence found at GenBank Accession No. X07465, nucleotides 1864–1886. Similarly, an exemplary antisense oligomer to *E. coli* secA has the sequence presented as SEQ ID NO:47 (Table 2A) and was designed based on the nucleic acid sequence found at GenBank Accession No. X55034 (nucleotides 24798–24817) and the corresponding protein sequence found at GenBank Accession No. CAA38851.

TABLE 2A

Exemplary Antisense Oligonucleotides Directed to Bacterial Cell Division and Cell Cycle

| Organism | Target | GenBank Acc. No. | Nucleotides (Target Seq.) | Corresp. Protein Seq. | Antisense Oligo | SEQ ID NO. |
|---|---|---|---|---|---|---|
| E. coli | dicF | X07465 | 1864–1886 | | GCATTCACCACATCACAAAATTC | 45 |
| E. coli | ftsZ | X02821 | 2361–2379 | | CAAACATAGTTTCTCTCCG | 46 |
| E. coli | secA | X55034 | 24798–24817 | CAA38851 | GATTAGCATAATAAAATCTC | 47 |
| E. coli | dicA | X07465 | 344–364 | CAA30349 | TTTTGTTTCCATAGTTAGCTA | 48 |
| E. coli | dicB | X07465 | 2019–2039 | CAA30351 | TAACGTTTTCATTATCGCGTC | 49 |
| E. coli | dicC | X07465 | 258–278 | CAA30348 | GTGTTTTAAATGCTTAAAACT | 50 |
| E. coli | ftsA | X55034 | 20503–20523 | CAA38871 | CGCCTTGATCATTGTTGTTCT | 51 |
| E. coli | ftsZ | X55034 | 21826–21846 | CAA38872 | TGGTTCAAACATAGTTTCTCT | 52 |
| E. coli | minC | D90751 | 12404–12424 | BAA36010 | AAGGCCAGGATGTCAAACACG | 53 |
| E. coli | murC | X55034 | 17286–17306 | CAA38868 | TTGTGTATTCATTCTTTACGC | 54 |
| E. coli | mraY | X55034 | 12523–12543 | CAA38864 | CCAAACTAACATGTCCCATTC | 55 |
| E. coli | seqA | D90707 | 12805–12825 | BAA35336 | AATCGTTTTCATCTTAATCCA | 56 |
| E. coli | zipA | U74650 | 396–416 | AAB42061 | ATCCTGCATCATTATATTCTC | 57 |
| E. coli | sulA | J01654 | 163–183 | AAA24230 | TGAAGTGTACATAATCAATCC | 58 |
| S. thyphi | | M16324 | 162–182 | AAA27230 | | |
| E. coli | met tRNA | K00296 | 33–51 | — | GTGACCCCATCATTATGAG | 59 |
| S. thyphi. | zipA | M21450 | 87–107 | | GAGAATATAATGATGCAGGAT | 60 |
| S. thyphi. | dicA | AF001386 | 9258–9278 | | AATGTGAATATGAACAAAAAT | 61 |
| P. aeruginosa | ftsZ | U19797 | 748–768 | AAA95993 | CAGTTCAAACATTTCCCCTCT | 62 |
| Vibrio cholera | murE | AF141867 | 130–150 | AAD29718 | AGCGGTTTTCATCAGGAGCAA | 63 |
| Vibrio cholera | sulA | X56018 | 168–188 | CAA39495 | ATATGCGGGCATTTACCCGTT | 64 |
| N. gonorrhoea | ftsZ | U76537 | 215–235 | AAB18965 | AACAAATTCCATTCAAAAACT | 65 |

TABLE 2B

Further Exemplary Antisense Oligos Directed to Bacterial Cell Division and Cell Cycle Sequences.

| Organism | Target | GenBank Acc. No. | Nucleotides (Target Seq.) | Corresp. Protein Seq. | Antisense Oligo | SEQ ID NO. |
|---|---|---|---|---|---|---|
| Staph. aureus | sulA | Z84573 | 124–144 | CAB06539 | TGTTTTAGTCATGTTAACCAC | 66 |
| Staph. aureus | secA | U97062 | 431–451 | AAB54024 | TAAAAATCCCATTTCGTTCGC | 67 |
| Staph. aureus | ftsZ | U94706 | 10043–10062 | AAC45629 | AAATTCTAACATTTAAATTTC | 68 |
| Staph. aureus | ftsA | U94706 | 8595–8615 | AAC45628 | ATGTTCTTCCATAGATAGGCA | 69 |
| Staph. aureus | murC | AF034076 | 1–21 | AAB87090 | GACAAAATGATAGTGTGTCAT | 70 |
| Staph. aureus | murD | U94706 | 5802–5822 | AAC45626 | ATAATTAAGCATCTTAATGCA | 71 |
| Staph. aureus | murE | Y14370 | 4711–4731 | CAA74740 | TCAGTTTGGATGCAAGTACGT | 72 |
| Staph. aureus | mraY | U94706 | 4834–4854 | AAC45625 | TACAAAAATCATAACTATCTC | 73 |
| M. tuberculosis | ftsZ | Z95388 | 17047–17067 | CAB08643 | AGCCGAACGATGACCCCCCCG | 74 |
| M. tuberculosis | murC | Z95388 | 18164–18184 | CAB08641 | GGTGCTGGGATGACGGAACAC | 75 |
| M. tuberculosis | murD | Z95388 | 22460–22480 | CAB08672 | GGTGATCCGGTAGGCGGGGGC | 76 |

TABLE 2B-continued

Further Exemplary Antisense Oligos Directed to Bacterial Cell Division and Cell Cycle Sequences.

| Organism | Target | GenBank Acc. No. | Nucleotides (Target Seq.) | Corresp. Protein Seq. | Antisense Oligo | SEQ ID NO. |
|---|---|---|---|---|---|---|
| M. tuberculosis | murE | Z95388 | 26527–26547 | CAB08669 | GCGGCGCGCATGATCGAGCTG | 77 |
| M. tuberculosis | mraY | Z95388 | 24998–25018 |  | TGTGCGCCCATGAGGCAGATC | 78 |
| H. pylori | secA | AE001503 | 7757–7777 | AAD06297 | TGCTTTTATCATGGTAGTAGT | 79 |
| H. pylori | ftsA | AE001520 | 5977–5997 | AAD06487 | TTTATGTTCCATGATTTCCCC | 80 |
| H. pylori | ftsZ | AE001520 | 7586–7606 | AAC06488 | TTGATGAACCATAGCTACTTT | 81 |
| H. pylori | murC | AE001489 | 13340–13360 | AAD06138 | GAGAAAATTATGCTTGAAACC | 82 |
| H. pylori | murD | AE001479 | 2101–2121 | AAD06024 | AGAAATTTTCATTTTAACACA | 83 |
| H. pylori | mraY | AE001561 | 2726–2746 | AAD06023 | TTTAAGCTTCATTCTTTAAGC | 84 |
| H. pylori | murE | AE001479 | 1038–1058 |  | AGAATAGAGCATAAAATCCCT | 85 |

TABLE 2C

Further Exemplary Antisense Oligos Directed to Bacterial Cell Division and Cell Cycle Sequences.

| Organism | Target | GenBank Acc. No. | Nucleotides (Target Seq.) | Corresp. Protein Seq. | Antisense Oligo | SEQ ID NO. |
|---|---|---|---|---|---|---|
| Strep. pneumoniae | sulA | U16156 | 236–256 | AAB63944 | TTTACTTGACATATCGGTCAC | 86 |
| Strep. pneumoniae | ftsA | AF068901 | 7003–7023 | AAC95439 | TTCTCTAGCCATTACATCGCT | 87 |
| Strep. pneumoniae | ftsZ | AF068901 | 8393–8413 | AAC95440 | TGAAAATGTCATAATTTATTT | 88 |
| Strep. pneumoniae | murD | AF068902 | 2673–2693 | AAC95449 | TATTACTTTCATGTCTCGAAC | 89 |
| Strep. pneumoniae | mraY | AF068903 | 4662–4682 | AAC95457 | GGAAATAAACATATTAGTCTC | 90 |
| T. palladium | secA | AE001217 | 4925–4945 | AAC65365 | CAGTACTCCATGCTCGTACGC | 91 |
| T. palladium | ftsA | AE001217 | 13234–13254 | AAC65373 | AACCTCACCCATAACTTTCCT | 92 |
| T. palladium | ftsZ | AE001217 | 14524–14544 | AAC65374 | TATATTCATCATTCCCCTCCC | 93 |
| T. palladium | murC | AE001213 | 13294–13314 |  | CCCCCGCTTCATGGGCGGATT | 94 |
| T. palladium | mraY | AE001214 | 5049–5069 |  | AATTAACCCCATCAACTACTA | 95 |
| C. trachomatis | murC | AE001348 | 8698–8718 | AAC68357 | GCTTTTCATCATGAGCCTATA | 96 |
| C. trachomatis | murD | AE001348 | 3547–3567 | AAC68353 | TAGGGGCAGCATCTGTTTTCT | 97 |
| C. trachomatis | mraY | AE001348 | 4569–4589 | AAC68352 | CTCCAATCCCATCTAACTCTC | 98 |
| C. trachomatis | ftsW | AE001348 | 6569–6589 | AAC68335 | GAACCATTTCATAATAATTCC | 99 |
| B. henselae | ftsZ | AF061746 | 986–1006 | AAC16008 | CAAAGATAACATTAGCATCTG | 100 |
| H. influenza | zipA | U32790 | 1048–1068 | AAC22756 | GGAATAAAAATGGATTTAAAT | 101 |
| H. influenza | mraY | U32793 | 6601–6621 |  | CCAGACTAACATTTAATTTTA | 102 |

Table 3, below, presents additional antisense oligonucleotides targeted to bacterial proteins involved in cell division and replication of *Enterococcus faecium* or *Enterococcus faecalis*. Carbamate kinase (CK) catalyzes the reversible reaction $NH_2COO^- + ATP \rightleftharpoons NHCOOPO_3^{(2-)} + ADP$, serving to synthesize ATP from carbamoyl phosphate in those microorganisms that derive energy from anaerobic argininine degradation via the arginine dihydrolase pathway (Marina, A. et al., *Eur. J. Biochem.* 253 (1):280–91, 1998). D-alanine:D-alanine ligase (dll) is essential for bacterial cell wall synthesis, assembling one of the subunits used for peptidoglycan crosslinking (Ellsworth, B. A. et al., *Chem. & Biol.* 3 (1):37–44, 1996).

Topoisomerases control the topology of coiled DNA and are thus critical to DNA replication. Thioredoxin reductase plays a role in the reduction of ribonucleotide phosphates to deoxyribonucleotide phosphates, by catalyzing the regeneration of reduced thioredoxin. Dihydrofolate reductase (DHFR) similarly plays a role in the synthesis of deoxythimidylate from deoxyuridylate, by catalyzing the regeneration of dihydrofolate from tetrahydrofolate.

Alkyl hydrogen peroxide reductase is induced by oxidative stress in bacteria (Storz, G. et al., *J. Bacteriol.* 171(4): 2049–55, 1989; Jacobson, F. S. et al., *J. Biol. Chem.* 264(3):488–96, 1989) and is understood to protect DNA against oxidative mutagenesis.

TABLE 3

Additional Antisense Oligonucleotides Directed to Target Proteins in *Enterococcus faecium* or *Enterococcus faecalis*

| Target Protein | Organism | GenBank Acc. No. | Nucleotides (Target Seq.) | Antisense Oligo | SEQ ID NO. |
|---|---|---|---|---|---|
| carbamate kinase | E. faecium | AJ223331 | 1–18 | GACCATTTTTTCCCCAT | 103 |
| D-ala D-ala ligase (ddl) | E. faecium | AF138282 | 291–307 | GATGAACGCATATGTAG | 104 |
| topoisomerase | E. faecalis | AB005036 | 9–25 | GCCGTCTTTATTCATTG | 105 |
| gelE (gelatinase; metalloendopeptidase) | E. faecalis | M37185 | 251–268 | CTTCATCAAACAATTAAC | 106 |

TABLE 3-continued

Additional Antisense Oligonucleotides Directed to Target Proteins in *Enterococcus faecium* or *Enterococcus faecalis*

| Target Protein | Organism | GenBank Acc. No. | Nucleotides (Target Seq.) | Antisense Oligo | SEQ ID NO. |
|---|---|---|---|---|---|
| repA | *E. faecalis* | AF109375 | 690–707 | CATTCCTTTCGCCCCTC | 107 |
| alkyl hydrogen peroxide reductase | *E. faecalis* | AF016233 | 672–689 | TAAATTCATTGTCGTTCC | 108 |
| thioredoxin reductase | *E. faecalis* | AF016233 | 1417–1434 | GGTATCCATCATTGCGCG | 109 |
| dihydrofolate reductase (DHFR) | *E. faecalis* | AF028812 | 386–404 | CAAACCTATCATCTATTTC | 110 |
| ftsA | *E. faecalis* | U94707 | 9123–9140 | GATGTTCATTTGACCTTC | 111 |
| cell wall enzyme | *E. faecalis* | L23802 | 724–741 | CTTAACATAAAATTACTC | 112 |

VII. Evaluation and Biological Activity of Exemplary Antisense Oligomers

In testing an oligomer for suitability in the present invention, each of the properties detailed above in Section II is preferably met. It is recognized that the "substantially uncharged" feature is inherently met where the linkages are uncharged, and the target-sequence complementarity is achieved by base-sequence design. Thus, an oligomer is preferably tested as to its (i) Tm with respect to target RNA at a duplex length preferably between 12–20 basepairs, (ii) ability to be transported across cell membranes by active or facilitated transport, and (iii) ability to prevent RNA proteolysis by RNaseH in duplex form, as described above in Section II.

The effectiveness of a given antisense oligomer may be determined by methods known in the art. For example, the oligomer may be incubated with a bacterial culture in vitro and the effect on the target nucleic acid evaluated by monitoring the presence or absence of (1) heteroduplex formation with the target sequence and non-target sequences using procedures known to those of skill in the art, e.g., an electrophoretic gel mobility assay; (2) the amount of mRNA for the target cell division or cell cycle protein, as determined by standard techniques such as RT-PCR or Northern blot; (3) the amount of bacterial protein production, as determined by standard techniques such as ELISA or Western blotting; or (4) the amount of bacterial growth in vitro for both bacteria known to have the target nucleic acid RNA sequence.

Candidate antisense oligomers may also be evaluated, according to well known methods, for acute and chronic cellular toxicity, such as the effect on protein and DNA synthesis as measured via incorporation of $^3$H-leucine and $^3$H-thymidine, respectively. In addition, various control oligonucleotides, e.g., one or more of control oligonucleotides such as sense, nonsense or scrambled antisense sequences, or sequences containing mismatched bases are generally included in the evaluation process, in order to confirm the specificity of binding of candidate antisense oligomers. The outcome of such tests are important to discern specific effects of antisense inhibition of gene expression from indiscriminate suppression. (See, e.g. Bennett, M. R. et al., *Circulation* 92(7):1981–1993, 1995). Accordingly, sequences may be modified as needed to limit non-specific binding of antisense oligomers to non-target sequences.

Figure 4A:
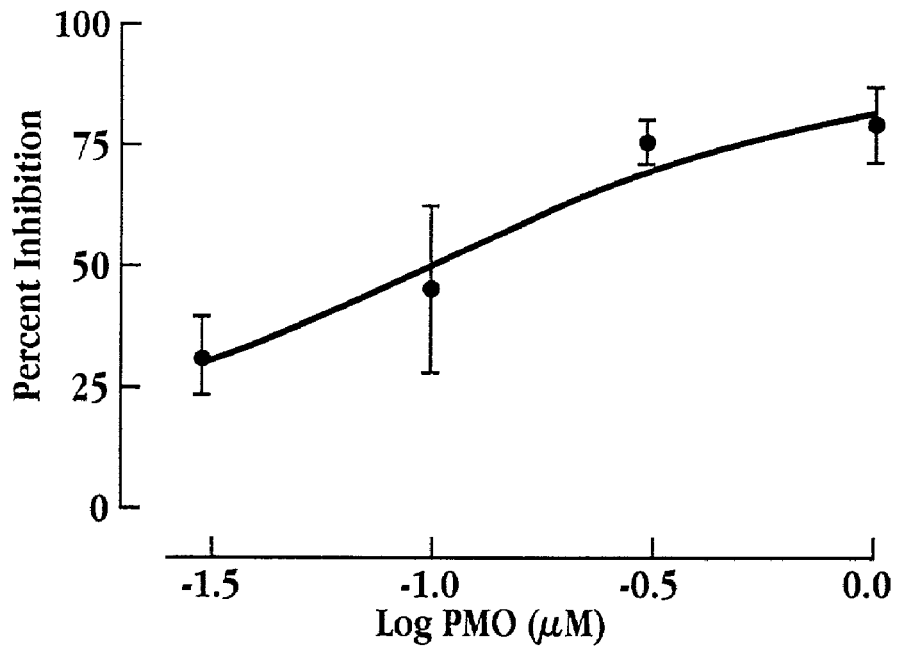
FIGS. 4A–C depict the effect of various concentrations of phosphorodiamidate-linked morpholino antisense oligomers specific to E. coli DicF (A), SecA (B), and met-tRNA (C), having the sequences SEQ ID NOs: 45, 47, and 59, respectively, on E. coli colony formation.
Figure 4B:
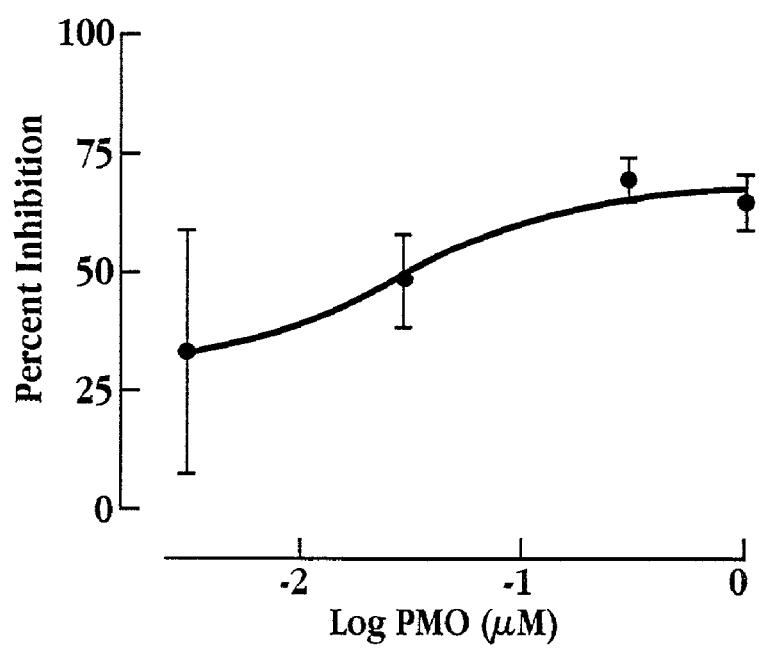
Figure 4C:
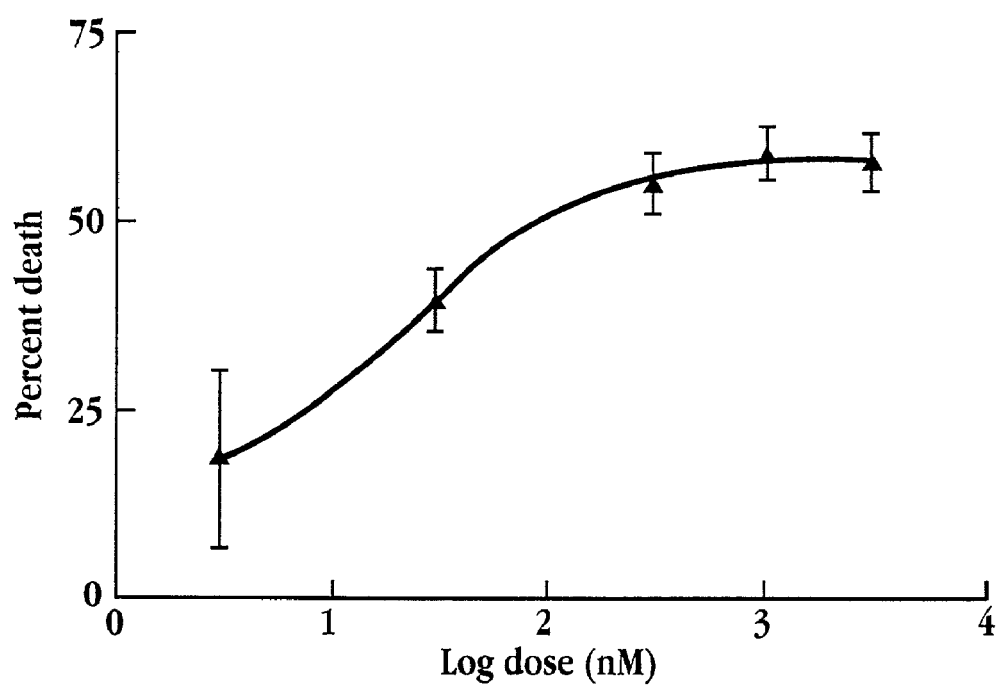

The effect of selected phosphodiamidate morpholino oligomers (PMOs) targeted to expression of endogenous bacterial cell division and cell cycle genes, or to bacterial tRNA, was evaluated by incubating *E. coli* with PMOs antisense to *E. coli* dicF mRNA, secA mRNA, or met-tRNA, having the sequences presented as SEQ ID NO:45, SEQ ID NO:47, and SEQ ID NO:59, respectively. The procedures were carried out as described in Materials and Methods, below. As indicated in FIGS. 4A–C, treatment of *E. coli* with these PMOs resulted in significant bacterial cell death at an antisense oligomer concentration of less than 100 nM. As shown in FIG. 4A, antisense PMO to dicF resulted in about 80% inhibition (20% viability) at 1.0 µM oligonucleotide.

The effect on viability of *Enterococcus faecium* of 1.0 µM of PMOs having sequences presented in Table 3, above, was similarly tested. Results are given in Table 4.

TABLE 4

Effect of Selected Antisense Oligonucleotides (1.0 µM) on Viability of *E. faecium*

| SEQ ID NO: | Target Protein | Percent Inhibition | S.E. (n = 3) |
|---|---|---|---|
| 103 | carbamate kinase | 51.5 | 3.8 |
| 104 | D-ala D-ala ligase (ddl) | 39.5 | 2.6 |
| 105 | topoisomerase | 64.0 | 4.7 |
| 106 | gelE (gelatinase; metalloendopeptidase) | 52.9 | 5.0 |
| 107 | repA | 55.2 | 5.8 |
| 108 | alkyl hydroperoxide reductase | 58.4 | 5.0 |
| 109 | thioredoxin reductase | 32.9 | 15.5 |
| 110 | dihydrofolate reductase | 56.6 | 6.6 |
| 111 | ftsA | 42.5 | 5.7 |
| 112 | cell wall enzyme | 36.1 | 8.9 |

The antisense oligonucleotides of the invention are thus effective as antibacterials, typically effecting 50–60%, and in some cases up to 80%, inhibition of growth. Studies in support of the invention have also shown failure of organisms to mutate to resistant strains after ten generations.

Upon exposure to the antisense PMO's of the invention, some bacteria appear to shut down transport, and enter a semi-dormant stage characterized by an abnormal cauliflower morphology. Accordingly, such oligonucleotides may also find utility in the preparation of anti-bacterial vaccines. In this aspect of the invention, a culture of a particular type of bacteria is incubated in the presence of a morpholino-based antisense oligomer of the type described above, in an amount effective to produce replication-crippled and/or morphologically abnormal bacterial cells. Such replication-crippled and/or morphologically abnormal bacterial cells are administered to a subject and act as a vaccine.

IX. In Vivo Administration of Antisense Oligomers

In one aspect, the invention is directed to slowing or limiting bacterial infection in vivo in a mammal and/or reducing or eliminating detectable symptoms typically associated with infection by that particular bacteria. The method comprises administering to a subject, in a suitable pharmaceutical carrier, an amount of an antisense agent effective to inhibit the biological activity of a bacterial cell division or cell cycle protein of interest.

The antisense oligonucleotides of the invention and pharmaceutical compositions containing them are useful for inhibiting bacterial infection in vivo in a mammal, and for inhibiting or arresting the growth of bacteria in the host. The bacteria may be decreased in number or eliminated with little or no detrimental effect on the normal growth or development of the host.

In some cases, the antisense oligomer will inhibit the growth of bacteria in general. In other cases, the antisense oligomer will be specific to one or more particular types of bacteria, e.g. a particular genus, species or strain.

It will be understood that the in vivo efficacy of such an antisense oligomer in a subject using the methods of the invention is dependent upon numerous factors including, but not limited to, (1) the target sequence; (2) the duration, dose and frequency of antisense administration; and (3) the general condition of the subject.

In other cases, the antisense oligonucleotides of the invention find utility in the preparation of anti-bacterial vaccines. In this aspect of the invention, a culture of a particular type of bacteria is incubated in the presence of a morpholino-based antisense oligomer of the type described above, in an amount effective to produce replication-crippled and/or morphologically abnormal bacterial cells. Such replication-crippled and/or morphologically abnormal bacterial cells are administered to a subject and act as a vaccine.

The efficacy of an in vivo administered antisense oligomer of the invention in inhibiting or eliminating the growth of one or more types of bacteria may be determined by in vitro culture or microscopic examination of a biological sample (tissue, blood, etc.) taken from a subject prior to, during and subsequent to administration of the antisense oligomer. (See, for example, Pari, G. S. et al., *Antimicrob. Agents and Chemotherapy* 39(5): 1157–1161, 1995; Anderson, K. P. et al., *Antimicrob. Agents and Chemotherapy* 40(9):2004–2011, 1996.) The efficacy of an in vivo administered vaccine of antisense oligomer-treated bacteria may be determined by standard immunological techniques for detection of an immune response, e.g., ELISA, Western blot, radioimmunoassay (RIA), mixed lymphoctye reaction (MLR), assay for bacteria-specific cytotoxic T lymphocytes (CTL), etc.

A. Administration Methods

Effective delivery of the antisense oligomer to the target nucleic acid is an important aspect of treatment. In accordance with the invention, such routes of antisense oligomer delivery include, but are not limited to, various systemic routes, including oral and parenteral routes, e.g., intravenous, subcutaneous, intraperitoneal, and intramuscular, as well as inhalation, transdermal and topical delivery. The appropriate route may be determined by one of skill in the art, as appropriate to the condition of the subject under treatment. For example, an appropriate route for delivery of an antisense oligomer in the treatment of a bacterial infection of the skin is topical delivery, while delivery of an antisense oligomer in the treatment of a bacterial respiratory infection is by inhalation. Methods effective to deliver the oligomer to the site of bacterial infection or to introduce the oligonucleotide into the bloodstream are also contemplated.

Transdermal delivery of antisense oligomers may be accomplished by use of a pharmaceutically acceptable carrier adapted for e.g., topical administration. One example of morpholino oligomer delivery is described in PCT patent application WO 97/40854, incorporated herein by reference.

In one preferred embodiment, the oligomer is a morpholino oligomer, contained in a pharmaceutically acceptable carrier, and is delivered orally.

The antisense oligonucleotide may be administered in any convenient vehicle which is physiologically acceptable. Such an oligonucleotide composition may include any of a variety of standard pharmaceutically accepted carriers employed by those of ordinary skill in the art. Examples of such pharmaceutical carriers include, but are not limited to, saline, phosphate buffered saline (PBS), water, aqueous ethanol, emulsions such as oil/water emulsions, triglyceride emulsions, wetting agents, tablets and capsules. It will be understood that the choice of suitable physiologically acceptable carrier will vary dependent upon the chosen mode of administration.

In some instances liposomes may be employed to facilitate uptake of the antisense oligonucleotide into cells. (See, e.g., Williams, S. A., *Leukemia* 10(12):1980–1989, 1996; Lappalainen et al., *Antiviral Res.* 23:119, 1994; Uhlmann et al., ANTISENSE OLIGONUCLEOTIDES: A NEW THERAPEUTIC PRINCIPLES, *Chemical Reviews*, Volume 90, No. 4, pages 544–584, 1990; Gregoriadis, G., Chapter 14, Liposomes, *Drug Carriers in Biology and Medicine*, pp. 287–341, Academic Press, 1979). Hydrogels may also be used as vehicles for antisense oligomer administration, for example, as described in WO 93/01286. Alternatively, the oligonucleotides may be administered in microspheres or microparticles. (See, e.g., Wu, G. Y. and Wu, C. H., *J. Biol. Chem.* 262:4429–4432, 1987.)

Sustained release compositions are also contemplated within the scope of this application. These may include semipermeable polymeric matrices in the form of shaped articles such as films or microcapsules.

Typically, one or more doses of antisense oligomer are administered, generally at regular intervals for a period of about one to two weeks. Preferred doses for oral administration are from about 1 mg oligomer/patient to about 25 mg oligomer/patient (based on a weight of 70 kg). In some cases, doses of greater than 25 mg oligomer/patient may be necessary. For IV administration, the preferred doses are from about 0.5 mg oligomer/patient to about 10 mg, oligomer/patient (based on an adult weight of 70 kg). The antisense compound is generally administered in an amount and manner effective to result in a peak blood concentration of at least 200–400 nM antisense oligomer.

In a further aspect of this embodiment, a morpholino antisense oligonucleotide is administered at regular intervals for a short time period, e.g., daily for two weeks or less. However, in some cases the antisense oligomer is administered intermittently over a longer period of time. Administration of a morpholino antisense oligomer to a subject may also be followed by, or concurrent with, administration of an antibiotic or other therapeutic treatment.

In one aspect of the method, the subject is a human subject, e.g., a patient diagnosed as having a localized or systemic bacterial infection. The condition of a patient may also dictate prophylactic administration of an antisense oligomer of the invention or an antisense oligomer treated bacterial vaccine, e.g. in the case of a patient who (1) is immunocompromised; (2) is a burn victim; (3) has an indwelling catheter; or (4) is about to undergo or has recently undergone surgery.

In another application of the method, the subject is a livestock animal, e.g., a chicken, turkey, pig, cow or goat, etc, and the treatment is either prophylactic or therapeutic.

The invention also includes a livestock and poultry food composition containing a food grain supplemented with a subtherapeutic amount of an antibacterial antisense compound of the type described above. Also contemplated is in a method of feeding livestock and poultry with a food grain supplemented with subtherapeutic levels of an antibiotic, an improvement in which the food grain is supplemented with a subtherapeutic amount of an antibacterial oligonucleotide composition as described above.

The methods of the invention are applicable, in general, to treatment of any condition wherein inhibiting or eliminating the growth of bacteria would be effective to result in an improved therapeutic outcome for the subject under treatment.

One aspect of the invention is a method for treatment of a bacterial infection which includes the administration of a morpholino antisense oligomer to a subject, followed by or concurrent with administration of an antibiotic or other therapeutic treatment to the subject.

B. Treatment Monitoring Methods

It will be understood that an effective in vivo treatment regimen using the antisense oligonucleotides of the invention will vary according to the frequency and route of administration, as well as the condition of the subject under treatment (i.e., prophylactic administration versus administration in response to localized or systemic infection). Accordingly, such in vivo therapy will generally require monitoring by tests appropriate to the particular type of bacterial infection under treatment and a corresponding adjustment in the dose or treatment regimen in order to achieve an optimal therapeutic outcome.

The efficacy of a given therapeutic regimen involving the methods described herein may be monitored, e.g., by general indicators of infection, such as complete blood count (CBC), nucleic acid detection methods, immunodiagnostic tests, or bacterial culture.

Identification and monitoring of bacterial infection generally involves one or more of (1) nucleic acid detection methods, (2) serological detection methods, i.e., conventional immunoassay, (3) culture methods, and (4) biochemical methods. Such methods may be qualitative or quantitative.

Nucleic acid probes may be designed based on publicly available bacterial nucleic acid sequences, and used to detect target genes or metabolites (i.e., toxins) indicative of bacterial infection, which may be specific to a particular bacterial type, e.g., a particular species or strain, or common to more than one species or type of bacteria (i.e., Gram positive or Gram negative bacteria). Nucleic amplification tests (e.g., PCR) may also be used in such detection methods.

Serological identification may be accomplished using a bacterial sample or culture isolated from a biological specimen, e.g., stool, urine, cerebrospinal fluid, blood, etc. Immunoassay for the detection of bacteria is generally carried out by methods routinely employed by those of skill in the art, e.g., ELISA or Western blot. In addition, monoclonal antibodies specific to particular bacterial strains or species are often commercially available.

Culture methods may be used to isolate and identify particular types of bacteria, by employing techniques including, but not limited to, aerobic versus anaerobic culture, growth and morphology under various culture conditions. Exemplary biochemical tests include Gram stain (Gram, 1884; Gram positive bacteria stain dark blue, and Gram negative stain red), enzymatic analyses (i.e., oxidase, catalase positive for *Pseudomonas aeruginosa*), and phage typing.

It will be understood that the exact nature of such diagnostic, and quantitative tests as well as other physiological factors indicative of bacterial infection will vary dependent upon the bacterial target, the condition being treated and whether the treatment is prophylactic or therapeutic.

In cases where the subject has been diagnosed as having a particular type of bacterial infection, the status of the bacterial infection is also monitored using diagnostic techniques typically used by those of skill in the art to monitor the particular type of bacterial infection under treatment.

The antisense oligomer treatment regimen may be adjusted (dose, frequency, route, etc.), as indicated, based on the results of immunoassays, other biochemical tests and physiological examination of the subject under treatment.

The following examples illustrate, but are in no way intended to limit the scope of the present invention.

MATERIALS AND METHODS

Standard recombinant DNA techniques were employed in all constructions, as described in Ausubel, FM et al., in CURRENT PROTOCOLS IN MOLECULAR BIOLOGY, John Wiley and Sons, Inc., Media, Pa., 1992 and Sambrook, J. et al., in MOLECULAR CLONING: A LABORATORY MANUAL, Cold Spring Harbor Laboratory Press, Cold Spring Harbor, N.Y., Vol. 2, 1989).

Bacterial Cultures. In evaluating the effectiveness of antisense oligonucleotides of the invention, approximately 3 ml bacterial cultures were aliquoted into plastic snap cap tubes from a 45 ml starting culture in Luria-Bertani (LB) Broth containing 4.5 mg of Ampicillin and a single colony of pCiNeo(myc)luc A from a freshly streaked LB agar plate containing 100 μg/mL ampicillin. Phosphorodiamidate morpholino oligomers diluted in phosphate buffered saline (PBS) were added to the cultures, incubated at 37° C. for a specific time, e.g., 16 or 26 hours with shaking at 210 rpm, then placed on ice for 15 minutes.

Culture staining microscopy and colony scanning. Bacterial cultures were stained in accordance with standard Gram staining protocols. The stained bacterium were visualized using a Nikon Optiphot-2 upright microscope, with images magnified 1000×, using the combination of an 100× oil immersion lens and the 10× magnification of the camera. A Nikon N8008S camera used to capture the images. The images were taken using bright field microscopy with a 4 second exposure on a setting 5 light output. A preferred film was Kodak Gold 400 ASA. After developing, the images were scanned using a Microtek Scan Maker 4, then cropped using Adobe PhotoShop.

The Sequence Listing is contained on separately submitted CD-ROM entitled 0450-0033.30-SEQLIST.TXT (772 KB) created Jul. 27, 2001 which is incorporated in entirety by reference herewith.

SEQUENCE LISTING (112 sequences)

SEQ ID NO: 1 - DNA, 4441 bp, Escherichia coli
gtcgacatatccaggcatccagagcctcacgagcctgttcaggagtgattttcattgttcaaccgccccgcccgcttcgtcttacgatattcatcataaactttgggatcatactgaagctccccgccagatgcctcctgtagacgcatcgcgcgaccttcgggaactaaatcccctttccagctataaagcgaagccaaacgaatacctgctgcttgtgcaagttttgtttttgaaccgaaatacaaaagagcgtcagttttaagcatttaaaacacctttattgttagtcataactaacaagatagatgttaacaaaaacatagtcaatacgatttagcattagctaactatggaaacaaaaaatttaactatcggcgaacgcatcaggtatcgtcggaaaaacctcaaacacacccaaaggtctcttgctaaagccctgaaaatctcccatgtgtctgtatcacaatgggaacggggtgatagtgaacctacagggaagaacctttttgccctcagtaaagtattgcaatgctcaccaacatggattctatttggcgatgaagacaagcaaccaacaccacctgttgagaagccagttgccttatcccccaaagaactagagctccttgagctgtttaatgcactgccagaatcagaacaggatacccagctcgccgaaatgcgagctcgagtaaaaaacttcaataaactctttgaagaattactaaaagcccgtcagcggacaaataaaagataacatcatcaatgagttatcttttaccacatcaattatgttagctatagcatacaaaatcacttgaccgatatgttagtcatggctaatcttgtttgcatcaacacaccgcacggtgttctcagcaaacagttccgctaccccagcgttaaggggaaatgaggtcagcatggatactatcgatcttggcaacaacgaatctctggtgtacggcgtgtttccaaaccaggacggcacgttcaccgcaatgacgtataccaaaagcaaaacgtttaaaaccgaaaatggtgcccgtcgctggctggaaagaaactcaggtgagtgatatggatttcgacacaatcatggaaaaggcttacgaagaatacttcgaaggccttgccgaaggcgaagaagctctcagcttcagtgagtttaaacaggcgctttccagttcggcaaaatctaacggctgataagcgaaacagcaccgcgaggaatcagtatgcagaaacgagaacccgtcatcatcgcgccagactataccgatgatgaactttatgagtggatgcgccagaaaattaatgcagcgcaggatctgaaatgggctaatgaagccagggctaagcaggctgaaaatctgtccgctctggagcaggatatcaccaatctggaaaaagcagcggcattaagcattgccagaatgattacatacccgcgttagtagctaatcaacaaagctaaggttagtaattaaggagttctccacgggtgaggtggagtgcgtgcgccggacacgggtgcgcatccggaactgacagtttactgaaaggatatttccctgaaaagtcagaccataacgcgaaagcgcatggcgaggtagctggttcatagatagcctgtcgttaaattttcgtcgaccgtgcgcttccggttgtggcaacccgcgaaatggcgcggcggtaagtatggcggggttattccttccccgttgaggacaccgggttgtcaggttgaccatacgcttaagtgacaaccccgctgcaacgccctctgttatcaattttctggtgacgtttggcggtatcagttttactccgtgactgctctgccgccctttttaaagtgaattttgtgatgtggtgaatgcggctgagcgcacgcggaacagttaaaaccaaaaacagtgttatgggtggattctctgtatccggcgttaattgttaactggttaacgtcacctggaggcaccaggcactgcatcacaaaattcattgttgaggacgcgataatgaaaacgttattaccaaacgttaatacgtctgaaggttgttttgaaattggtgtcactatcagtaacccagtatttactgaagatgccattaacaagagaaaacaagaacggcagctattaaataaaatatgcattgtttcaatgctggctcgtttacgtctgatgccaaaaggatgtgcacaatgaattcagcatttgtgcttgttctgacagtttttcttgtttccggagagccagttgatattgcagtcagtgttcacaggacaatgcaggagtgtatgactgcagcaaccgaacagaaaattcccggtaactgttacccggtcgataaagttattcaccaggataatatcgaaatcccggcaggtctttaaaacagttccgtaataaatatccggtttcattcttatatgccagcaatggcagggatttgttcatccttaaatctgtcatgaggttaaaacaaatgagtaaagtctttatttgcgccgctattcctgacgaactggcaacaagggaagaaggcgctgtggctgtagccacagccattgaagctggcgacgaacgccgtgctcgagcaaaatttcactggcaattcctggaacattatccggctgctcaggactgcgcttataaatttattgtctgcgaggataaacctggcataccccgccctgccctcgattcatgggatgctgaatatatgcaggaaaaccgctgggatgaggagtctgcttcttttgtcccggttgagactgaatccgatccgatgaacgtcacttttgacaagctggcccctgaagtacagaacgctgtcatggttaagttcgacacatgtgaaaacatcaccgttgatatggttattagcgcacaggaattgttgcaggaagacatggcaacattcgacggacatatcgttgaagcgttgatgaaaatgccagaagttaacgccatgtatccggagcttaagttgcacgccattgggtgggttaagcataaatgtattcctggtgctaaatggcccgaaattcaggcagagatgcgcatctggaaaaaacgtcgcgaaggtgaacgcaaggaaaccggaaaatacacgtctgttgttgatctcgcccgcgccagagccaatcaacagtacactgaaaattcaacaggaaaaatcagcccggtcattgctgccattcatcgcgaatacaagcagacatggaaaacactggatgacgaactggcctatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtgatcgtgaggcactgcactgggcggtcactaccggcggcttcaacagtgaaacagtacaggacgtcatgctgggagcggtggaacgccgcttcggcaacgatcttccgtcgtctccagtggagtggctgacggataatggttcatgctaccgggctaatgaaacacgccagttcgcccggatgttgggacttgaaccgaagaacacggcggtgcggagtccggagagtaacggaatagcagagagcttcgtgaaaacgataaagcgtgactacatcagtatcatgcccaaaccagacgggttaacggcagcaaagaaccttgcagaggcgttcgagcattataacgaatggcatccgcatagtgcgctgggttatcgctcgccacgggaatatctgcggcacgggcttgtaatgggttaagtgataacagatgtctggaaatataggggcaaatccacaggtgaactacgctcctctgtttgttacgcaataaaaactggtgttttcgactatgcaaaacagtttccctcctcacgcaatctggaaaaatttggtgaggcccgacaagatttaaccataaaagaactggctgaaaaatttctggcactgaaagaaactgaagtcgccaaaacatcactcaacacataccgtgccgtcatcaaaaatatcctgagcataatcggtgaaaaaaatcttgcctcatcgattaataaagaaaaattactggaggttcgtaaagagttactgactggataccagatccccaaaagtaactatattgttacacaaccagggagatcggctgtaactgtaaataattacatgacaaatcttaacgccgtgttccagtttggtgttgataacggttacctggcagataatccgtttaaggggatctcgccattaaaggaatcaagaaccattccggatcc

SEQ ID NO: 2 - DNA, 28277 bp, Escherichia coli
tgcctgtaacgcctgttcaccgtcgcgcaatgtggtatcgaaaataatgacttgctggctcatggtttgggtccttgtctcttttagagcgcctcgcttcgggcataaaaaaacccgcgcaatggcgcgggttttttgtttgactgcgtgctggcttaatgctggatgccgctcactcgtctaccgcgcaaagaagatgcgtttagtagtagtagaccgataaagcgaacgatgtgagtcattaaatcagctccagatgaatgcgatatgcttttagagttactggatacaaaaacggatgtcaaccctgacgcaataaaaacgtcccgccagcgtgagttctgcatccgtaaaattagctaattgtgctgcggtggttaaagtaagcgatattaatttctgcttaactaccgacgcttttcatcggttgacatatttcagcataaatttttgcatctaatcaacgaggaaaaaggggacaaaatgcacgcgttgcaaaacctatcctgatgatttgtattgaattatatgttttgcgattttttttgatattgatttggtgaatattattgatcaattaatgttaagaattaatgcattaaatatataaattaattattaaataagcacatttaatccattttgtagatgattgagtattcgcggtagttatgattagattgttttcgcaacaaaaacattatggattattatgctgtggtaaatgactcattccacggcaatggattctgtttttatcagaacccgtatctttatgttttccgaattttactcattttgctttttcttattttatatgcatgataaatcatattcttcaggattatttctctgcattccaataagggaaagggagttaagtgtgacagtggagttaagtatgccagaggtacaaacagatcatccagagacggcggagttaagcaaaccacagctacgcatggtcgatctcaacttattaaccgttttcgatgccgtgatgcaggagcaaaacattactcgtgccgctcatgttctgggaatgtcgcaacctgcggtcagtaacgctgttgcacgcctgaaggtgatgtttaatgacgagctttttgttcgttatggccgtggtattcaaccgactgctcgcgcatttcaactttttggttcagttcgtcaggcattgcaactagtacaaaatgaattgcctggttcaggttttgaacccgcgagcagtgaacgtgtatttcatctttgtgtttgcagcccgttagacagcattctgacctcgcagatttataatcacattgagcagattgcgccaaatatacatgttatgttcaagtcttcattaaatcagaacactgaacatcagctgcgttatcaggaaacggagtttgtgattagttatgaagacttccatcgtcctgaatttaccagcgtaccattatttaaagatgaaatggtgctggtagccagcaaaaatcatccaacaattaagggcccgttactgaaacatgatgtttataacgaacaacatgcggcggtttcgctcgatcgtttcgcgtcatttagtcaaccttggtatgacacggtagataagcaagccagtatcgcgtatcagggcatggcaatgatgagcgtacttagcgtggtgtcgcaaacgcatttggtcgctattgcgccgcgttggctggctgaagagttcgctgaatccttagaattacaggtattaccgctgccgttaaaacaaaacagcagaacctgttatctctcctagcatgaagctgccgggcgcgataaaggccatcagtggatggaagagcaattagtctcaatttgcaaacgctaactgattgcagaataggtcagacatgaatgtctggtttattctgcattttttattgaatgtagaattttattctgaatgtgtgggctctctattttaggattaattaaaaaaatagagaaattgctgtaagttgtgggattcagccgatttattatcaatttaatcctctgtaatggaggattttatcgtttcttttcacctttcctcctgtttattcttattaccccgtgtttatgtctctggctgccaattgcttaagcaagatcggacggttaatgtgttttacacattttttccgtcaaacagtgaggcaggccatggagatgttgtctggagccgagatggtcgtccgatcgcttatcgatcagggcgttaaacaagtattcggttatcccggaggcgcagtccttgatatttatgatgcattgcataccgtgggtggtattgatcatgtattagttcgtcatgagcaggcggcggtgcatatggccgatggcttggcgcgcgcgaccggggaagtcggcgtcgtgctggtaacgtcgggtccaggggcgaccaatgcgattactggcatcgccaccgcttatatggattccattccattagttgtcctttccgggcaggtagcgacctcgttgataggttacgatgcctttcaggagtgcgacatggtggggatttcgcgacccgtggttaaacacagttttctggttaagcaaacggaagacattccgcaggtgctgaaaaaggctttctggctggcggcaagcggtcgcccaggaccagtagtcgttgatttaccgaaagatattcttaatccggcgaacaaattaccctatgtctggccggagtcggtcagtatgcgttcttacaatcccactactaccggacataaagggcaaattaagcgtgctctgcaaagcgtggtagcggtaaaaaaaccggttgtctacgtaggcggtggggcaatcacggcgggctgccatcagcagttgaaagaaacggtggaggcgttgaatctgcccgttgtttgctcattgatggggctgggggcgtttccggcaacgcatcgtcaggtactgggtatgctgggaatgcacggtacctacgaagccaatatgacgatgcataacgcggatgtgattttcgccgtcggggtacgatttgatgaccgaacgacgaacaatctggcaaagtactgcccaaatgccactgttctgcatatcgatattgatcctacttccatttctaaaaccgtgactgcggatatcccgattgtgggggatgctcgccaagtcctcgaacaaatgcttgaactcttgtcgcaagaatccgcccatcaaccactggatgagatccgcgactggtggcagcaaattgaacagtggcgcgctcgtcagtgcctgaaatatgacactcacagtgaaaagattaaaccgcaggcggtgatcgagactctttggcggttgacgaagggagacgcttacgtgacgtccgatgtcgggcagcaccagatgtttgctgcactttattatccattcgacaaaccgcgtcgctggatcaattccggtggcctcggcagcatgggttttggtttacctgcggcactgggcgtcaaaatggcgttcgcagaagaaaccgtggtttgcgtcactggcgacggcagtattcagatgaacatccaggaactgtctaccgcgttgcaatacgagttgcccgtactggtggtgaatctcaataaccgctatctggggatggtgaagcagtggcaggacatgatctattccggccgtcattcacaatcttatatgcaatcgctacccgatttcgtccgtcgcggagcctatgggcatgtcgggatccagatttctcatccgcatggctggaaagcaaacttagcgaggcgctggaacaggtgcgcaataatcgcctggtgtttgttgatgttaccgtcgatggcagcgagcacgtctacccgatgcagattcgcgggggcggaatggatgaaatgtggttaagcaaaacggagagaacctgattatgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtacttgagcagatcgaaaagcaattacacaaactggtcgatgtcttgcgcgtgagtgagttggggcagggcgcgcatgttgagcgggaaatcatgctggtgaaaattcaggccagcggttacgggcgtgacgaagtgaaacgtaatacggaaatattccgtgggcaaattatcgatgtcacaccctcgctttataccgttcaattagcaggcaccagcggtaagcttagtgcatttttagcatcgattcgcgatgtggcgaaaattgtggaggttgctcgctctggtgtggtcggactttcgcgcggcgataaaataatgcgttgagaatgatctcaatgcgcaatttacagcccaacatgtcacgttgggctttttttgcgaaatcagtgggaacctggaataaaagcagttgccgcagttaattttctgcgcttagatgttaatgaatttaacccataccagtacaatggctatggtttttacattttacgcaaggggcaattgtgaaactggatgaaatcgctcggctggcgggagtgtcgcggaccactgcaagctatgttattaacggcaaagcgaagcaataccgtgtgagcgacaaaaccgttgaaaaagtcatggctgtggtgcgtgagcacaattaccacccgaacgccgtggcagctgggcttcgtgctggacgcacacgttctattggtcttgtgatccccgatctggagaacaccagctatacccgcatcgctaactatcttgaacgccaggcgcggcaacggggttatcaactgctgattgcctgctcagaagatcagccagacaacgaaatgcggtgcattgagcaccttttacagcgtcaggttgatgccattattgtttcgacgtcgttgcctcctgagcatcctttttatcaacgctgggctaacgacccgttcccgattgtcgcgctggaccgcgccctcgatcgtgaacacttcaccagcgtggttggtgccgatcaggatgatgccgaaatgctggcggaagagttacgtaagtttcccgccgagacggtgctttatcttggtgcgctaccggagctttctgtcagcttcctgcgtgaacaaggtttccgtactgcctggaaagatgatccgcgcgaagtgcatttcctgtatgccaacagctatgagcgggaggcggctgcccagttattcgaaaaatggctggaaacgcatccgatgccgcaggcgctgttcacaacgtcgtttgcgttgttgcaaggagtgatggatgtcacgctgcgtcgcgacggcaaactgccttctgacctggcaattgccacctttggcgataacgaactgctcgacttcttacagtgtccggtgctggcagtggctcaacgtcaccgcgatgtcgcagagcgtgtgctggagattgtcctggcaagcctggacgaaccgcgtaagccaaaacctggtttaacgcgcattaaacgtaatctctatcgccgcggcgtgctcagccgtagctaagccgcgaacaaaaatacgcgccaggtgaatttccctctggcgcgtagagtacgggactggacatcaatatgcttaaagtaaataagactattcctgactattattgataaatgcttttaaacccgcccgttaattaactcaccagctgaaattcacaataattaagtgatatcgacagcgcgtttttgcattattttgttacatgcggcgatgaattgccgatttaacaaacacttttctttgcttttgcgcaaacccgctggcatcaagcgccacacagacgtaacaaggactgttaaccggggaagatatgtcctaaaatgccgctcgcgtcgcaaactgacactttatatttgctgtggaaaatagtgagtcattttaaaacggtgatgacgatgagggattttttcttacagctattcataacgttaatttgcttcgcacgttggacgtaaaataaacaacgctgatattagccgtaaacatcgggttttttacctcggtatgccttgtgactggcttgacaagcttttcctcagctccgtaaactcctttcagtgggaaattgtggggcaaagtgggaataaggggtgaggctggcatgttccggggagcaacgttagtcaatctcgacagcaaagggcgcttatcagtgcctacccgttatcgggaacagctgcttgagaacgctgccggtcaaatggtttgcaccattgacatttatcacccgtgcctgctgctttaccccctgcctgaatgggaaattatcgagcaaaaattatcgcgtctgtcgagcatgaacccggttgagcgccgtgtgcagcgcctactgttaggtcatgccagcgaatgtcagatggatggcgcaggtcgattgttaatcgcgccagtactgcggcaacatgccgggctgacaaaagaagtgatgctggttggacagttcaacaagtttgagctgtgggatgaaacaacctggcatcaacaggtcaaggaagatatcgacgcagagcagttggctaccggagacttatcggagcgactgcaggacttgtctctataaaatgatggaaaactataaacatactacggtgctgctggatgaagccgttaatggcctcaatatccgtcctgatggcatctacattgatgggacttttggtcgcggtggtcactcacgtctgatcctctcgcagcttggcgaagaggggcgtttgctggcgatcgatcgcgacccgcaggctatcgccgttgcgaagactattgatgatccgcgcttctccatcatccacggacctttctccgcgctgggcgaatacgttgccgagcgcgatcttatcggcaagatcgacggcattctcctcgatcttggcgtctcttcaccgcaacttgatgatgctgaacgtggcttttcctttatgcgcgatggtccgctggacatgcgtatggacccaacccgtgggcagtcagccgctgaatggctacaaaccgcagaagaagccgatatcgcctgggtattgaaaacctatggtgaagagcgttttgccaaacgcattgcccgcgccattgtcgagcgtaaccgcgaacagccgatgacccgcaccaaagaactggcggaagtcgtggctgctgcaacgccggtgaaagataagtttaaacatcccgcgacccgtaccttccaggcggtgcgcatttgggtaaacagtgaactggaggagatagagcaggcgctaaaaagctcgctcaacgtgctggccccgggtgggcggctttcgatcatcagcttccactcgctggaagaccgtattgtgaaacgttttatgcgtgaaaacagccgcggtccgcaagttccggcagggttaccgatgactgaagagcagctcaaaaaactgggtggccgtcagctgcgagcactaggcaagttaatgccgggcgaagaagaggtggctgagaaccctcgtgcccgtagttcagttctgcgtattgcagagaggacgaatgcatgatcagcagagtgacagaagctctaagcaaagttaaaggatcgatgggaagccacgagcgccatgcattgcctggtgttatcggtgacgatcttttgcgatttgggaagctgccactctgcctgttcatttgcattattttgacggcggtgactgtggtaaccacggcgcaccatacccgtttactgaccgctcagcgcgaacaactggtgctggagcgagatgctttagacattgaatggcgcaacctgatccttgaagagaatgcgctcggcgaccatagccgggtggaaaggatcgccacggaaaagctgcaaatgcagcatgttgatccgtcacaagaaaatatcgtagtgcaaaaataaggataaacgcgacgcatgaaagcagcggcgaaaacgcagaaaccaaaacgtcaggaagaacatgccaactttatcagttggcgttttgcgttgttatgcggctgtattctcctggcgctggcttttctgctcggacgcgtagcgtggttacaagttatctccccggatatgctggtgaaagagggcgacatgcgttctcttcgcgttcagcaagtttccacctcccgcggcatgattactgaccgttctggtcgcccgttagcggtgagcgtgccggtaaaagcgatttgggctgacccgaaagaagtgcatgacgctggcggtatcagcgtcggtgaccgctggaaggcgctggctaacgcgctcaatattccgctggatcagctttcagcccgcattaacgccaacccgaaagggcgctttatttatctggcgcgtcaggtgaaccctgacatggcggactacatcaaaaaactgaaactgccggggattcatctgcgtgaagagtctcgccgttactatccgtccggcgaagtgactgctcacctcatcggctttactaacgtcgatagtcaagggattgagggcgttgagaagagtttcgataaatggcttaccgggcagccgggtgagcgcattgtgcgtaaagaccgctatggtcgcgtaattgaagatatttcttctactgacagccaggcagcgcacaacctggcgctgagtattgatgaacgcctgcaggcgctggtttatcgcgaactgaacaacgcggtggcctttaacaaggctgaatctggtagcgccgtgctggtggatgtcaacaccggtgaagtgctggcgatggctaacagcccgtcatacaaccctaacaatctgagcggcacgccgaaagaggcgatgcgtaaccgtaccatcaccgacgtgtttgaaccgggctcaacggttaaaccgatggtggtaatgaccgcgttgcaacgtggcgtggtgcgggaaaactcggtactcaataccattccttatcgaattaacggccacgaaatcaaagacgtggcacgctacagcgaattaaccctgaccggggtattacagaagtcgagtaacgtcggtgtttccaagctggcgttagcgatgccgtcctcagcgttagtagatacttactcacgttttggactgggaaaagcgaccaatttggggttggtcggagaacgcagtggcttatatcctcaaaaacaacggtggtctgacatagagagggccaccttctctttcggctacgggctaatggtaacaccattacagttagcgcgagtctacgcaactatcggcagctacggcatttatcgcccactgtcgattaccaaagttgaccccccggttcccggtgaacgtgtcttcccggaatccattgtccgcactgtggtgcatatgatggaaagcgtggcgctaccaggcggcggcggcgtgaaggcggcgattaaaggctatcgtatcgccattaaaaccggtaccgcgaaaaaggtcgggccggacggtcgctacatcaataaatatattgcttataccgcaggcgttgcgcctgcgagtcagccgcgcttcgcgctggttgttgttatcaacgatccgcaggcgggtaaatactacggcggcgccgtttccgcgccggtctttggtgccatcatgggcggcgtattgcgtaccatgaacatcgagccggatgcgctgacaacgggcgataaaaatgaatttgtgattaatcaaggcgaggggacaggtggcagatcgtaatttgcgcgaccttcttgctccgtgggtgccagacgcaccttcgcgagcactgcgagagatgacactcgacagccgtgtggctgcggcgggcgatctctttgtagctgtagtaggtcatcaggcggacgggcgtcgatatatcccgcaggcgatagcgcaaggtgtggctgccattattgcagaggcgaaagatgaggcgaccgatggtgaaatccgtgaaatgcacggcgtaccggtcatctatctcagccagctcaacgagcgtttatctgcactggcgggccgcttttaccatgaaccctctgacaatttacgtctcgtgggcgtaacgggcaccaacggcaaaaccacgactacccagctgttggcgcagtggagccaactgcttggcgaaatcagcgcggtaatgggcaccgttggtaacggcctgctggggaaagtgatcccgacagaaaatacaaccggttcggcagtcgatgttcagcatgagctggcggggctggtggatcagggcgcgacgttttgcgcaatggaagtttcctcccacgggctggtacagcaccgtgtggcggcattgaaatttgcggcgtcggtctttaccaacttaagccgcgatcaccttgattatcatggtgatatggaacactacgaagccgcgaaatggctgctttattctgagcatcattgcggtcaggcgattattaacgccgacgatgaagtgggccgccgctggctggcaaaactgccggacgcggttgcggtatcaatggaagatcatattaatccgaactgtcacggacgctggttgaaagcgaccgaagtgaactatcacgacagcggtgcgacgattcgctttagctcaagttggggcgatggcgaaattgaaagccatctgatgggcgcttttaacgtcagcaacctgctgctcgcgctggcgacactgttggcactcggctatccactggctgatctgctgaaaaccgccgcgcgtctgcaaccggtttgcggacgtatggaagtgttcactgcgccaggcaaaccgacggtggtggtggattacgcgcatacgccggatgcactggaaaaagccttacaggcggcgcgtctgcactgtgcgggcaagctgtggtgtgtctttggctgtggtggcgatcgcgataaaggtaagcgtccactgatgggcgcaattgccgaagagtttgctgacgtggcggtggtgacggacgataacccgcgtaccgaagaaccgcgtgccatcatcaacgatattctggcgggaatgttagatgccggacatgccaaagtgatggaaggccgtgctgaagcggtgacttgcgccgttatgcaggctaaagagaatgatgtggtactggtcgcgggcaaaggccatgaagattaccagattgttggcaatcagcgtctggactactccgatcgcgtcacggtggcgcgtctgctgggggtgattgcatgattagcgtaacccttagccaacttaccgacattctcaacggtgaactgcaaggtgcagatatcacccttgatgctgtaaccactgatacccgaaaactgacgccgggctgcctgtttgttgccctgaaaggcgaacgttttgatgcccacgattttgccgaccaggcgaaagctggcgcggcaggcgcactactggttagccgtccgctggacatcgacctgccgcagttaatcgtcaaggatacgcgtctggcgtttggtgaactggctgcatgggttcgccagcaagttccggcgcgcgtggttgctctgacggggtcctccggcaaaacctccgttaaagagatgacggcggcgattttaagccagtgcggcaacacgctttatacggcaggcaatctcaacaacgacatcggtgtaccgatgacgctgttgcgcttaacgccggaatacgattacgcagttattgaacttggcgcgaaccatcagggcgaaatagcctggactgtgagtctgactcgcccggaacgtgcgctggtcaacaacctggcagcggcgcatctggaaggttttggctcgcttgcgggtgtcgcgaaagcgaaaggtgaaatctttagcggcctgccggaaaacggtatcgccattatgaacgccgacaacaacgactggctgaactggcagagcgtaattggctcacgcaaagtgtggcgtttctcacccaatgccgccaacagcgatttcaccgccaccaatatccatgtgacctcgcacggtacggaatttaccctacaaaccccaaccggtagcgtcgatgttctgctgccgttgccggggcgtcacaatattgcgaatgcgctggcagccgctgcgctctccatgtccgtgggcgcaacgcttgatgctatcaaagcggggctggcaaatctgaaagctgttccaggccgtctgttccccatccaactggcagaaaaccagttgctgctcgacgactcctacaacgccaatgtcggttcaatgactgcagcagtccaggtactggctgaaatgccgggctaccgcgtgctggtggtgggcgatatggcggaactgggcgctgaaagcgaagcctgccatgtacaggtgggcgaggcggcaaaagctgctggtattgaccgcgtgttaagcgtgggtaaacaaagccatgctatcagcaccgccagcggcgttggcgaacattttgctgataaaactgcgttaattacgcgtcttaaattactgattgctgagcaacaggtaattacgattttagttaagggttcacgtagtgccgccatggaagaggtagtacgcgctttacaggagaatgggacatgttagtttggctggccgaacatttggtcaaatattattccggctttaacgtcttttcctatctgacgtttcgcgccatcgtcagcctgctgaccgcgctgttcatctcattgtggatgggcccgcgtatgattgctcatttgcaaaaactttcctttggtcaggtggtgcgtaacgacggtcctgaatcacacttcagcaagcgcggtacgccgaccatgggcgggattatgatcctgacggcgattgtgatctccgtactgctgtgggcttacccgtccaatccgtacgtctggtgcgtgttggtggtgctggtaggttacggtgttattggctttgttgatgattatcgcaaagtggtgcgtaaagacaccaaagggttgatcgctcgttggaagtatttctggatgtcggtcattgcgctgggtgtcgccttcgccctgtaccttgccggcaaagacacgcccgcaacgcagctggtggtcccattctttaaagatgtgatgccgcagctggggctgttctacattctgctggcttacttcgtcattgtgggtactggcaacgcggtaaacctgaccgatggtctcgacggcctggcaattatgccgaccgtatttgtcgccggtggttttgcgctggtggcgtgggcgaccggcaatatgaactttgccagctacttgcatataccgtatctgcgacacgccggggaactggttattgtctgtaccgcgatagtcggggcaggactgggcttcctgtggtttaacacctatccggcgcaggtctttatgggcgatgtaggttcgctggcgttaggtggtgcgttaggcattatcgccgtactgctacgtcaggaattcctgctggtgattatggggggcgtgttcgtggtagaaacgctttctgtcatcctgcaggtcggctcctttaaactgcgcggacaacgtattttccgcatggcaccgattcatcaccactatgaactgaaaggctggccggaaccgcgcgtcattgtgcgtttctggattatttcgctgatgctggttctgattggtctggcaacgctgaaggtacgttaatcatggctgattatcagggtaaaaatgtcgtcattatcggcctgggcctcaccgggctttcctgcgtggactttttcctcgctcgcggtgtgacgccgcgcgttatggatacgcgtatgacaccgcctggcctggataaattacccgaagccgtagaacgccacacgggcagtctgaatgatgaatggctgatggcggcagatctgattgtcgccagtcccggtattgcactggcgcatccatccttaagcgctgccgctgatgccggaatcgaaatcgttggcgatatcgagctgttctgtcgcgaagcacaagcaccgattgtggcgattaccggttctaacggcaaaagcacggtcaccacgctagtgggtgaaatggcgaaagcggcgggggttaacgttggtgtgggtggcaatattggcctgcctgcgttgatgctactggatgatgagtgtgaactgtacgtgctggaactgtcgagcttccagctggaaaccacctccagcttacaggcggtagcagcgaccattctgaacgtgactgaagatcatatggatcgctatccgtttggtttacaacagtatcgtgcagcaaaactgcgcatttacgaaaacgcgaaagtttgcgtggttaatgctgatgatgccttaacaatgccgattcgcggtgcggatgaacgctgcgtcagctttggcgtcaacatgggtgactatcacctgaatcatcagcagggcgaaacctggctgcgggttaaaggcgagaaagtgctgaatgtgaaagagatgaaactttccgggcagcataactacaccaatgcgctggcggcgctggcgctggcagatgctgcagggttaccgcgtgccagcagcctgaaagcgttaaccacattcactggtctgccgcatcgctttgaagttgtgctggagcataacggcgtacgttggattaacgattcgaaagcgaccaacgtcggcagtacggaagcggcgctgaatggcctgcacgtagacggcacactgcatttgttgctgggtggcgatggtaaatcggcggactttagcccactggcgcgttacctgaatggcgataacgtacgtctgtattgtttcggtcgtgacggcgcgcagctggcggcgctacgcccggaagtggcagaacaaaccgaaactatggaacaggcgatgcgcttgctggctccgcgtgttcagccgggcgatatggttctgctctccccagcctgtgccagccttgatcagttcaagaactttgaacaacgaggcaatgagtttgcccgtctggcgaaggagttaggttgatgcgtttatctctccctcgcctgaaaatgccgcgcctgccaggattcagtatcctggtctggatctccacggcgctaaagggctgggtgatgggctcgcgggaaaaagataccgacagcctgatcatgtacgatcgcaccttactgtggctgaccttcggcctcgcggcgattggctttatcatggtgacctcggcgtcaatgcccatagggcaacgcttaaccaacgatccgttcttcttcgcgaagcgtgatggtgtctatctgattttggcgtttattctggcgatcattacgctgcgtctgccgatggagttctggcaacgctacagtgccacgatgctgctcggatctatcatcctgctgatgatcgtcctggtagtgggtagctcggttaaaggggcatcgcgttggatcgatctcggtttgctgcgtatccagcctgcggagctgacaaaactgtcgctgttttgctatatcgccaactatctggtgcgtaaaggcgacgaagtacgtaataacctgcgcggcttcctgaaaccgatgggcgtgattctggtgttggcagtgttactgctggcacagccagaccttggtacggtggtggtgttgtttgtgactacgctggcgatgttgttcctggcgggagcgaaattgtggcagttcattgccattatcggtatgggcatttcagcggttgtgttgctgatactcgccgaaccgtaccgtatccgccgtgttaccgcattctggaacccgtgggaagatccctttggcagcggctatcagttaacgcaatcgctgatggcgtttggtcgcggcgaactttgggggcaaggtttaggtaactcggtacaaaaactggagtatctgccggaagcgcacactgactttattttcgccattatcggcgaagaactggggtatgtcggtgtggtgctggcacttttaatggtattcttcgtcgcttttcgcgcgatgtcgattggccgtaaagcattagaaattgaccaccgtttttccggttttctcgcctgttctattggcatctggtttagcttccaggcgctggttaacgtaggcgcggcggcggggatgttaccgaccaaaggtctgacattgccgctgatcagttacggtggttcgagcttactgattatgtcgacagccatcatgatgctgttgcgtattgattatgaaacgcgtctggagaaagcgcaggcgtttgtacgaggttcacgatgagtggtcaaggaaagcgattaatggtgatggcaggcggaaccggtggacatgtattcccgggactggcggttgcgcaccatctaatggctcagggttggcaagttcgctggctggggactgccgaccgtatggaagcggacttagtgccaaaacatggcatcgaaattgatttcattcgtatctctggtctgcgtggaaaaggtataaaagcactgatagctgccccgctgcgtatcttcaacgcctggcgtcaggcgcgggcgattatgaaagcgtacaaacctgacgtggtgctcggtatgggaggctacgtgtcaggtccaggtggtctggccgcgtggtcgttaggcattccggttgtacttcatgaacaaaacggtattgcgggcttaaccaataaatggctggcgaagattgccaccaaagtgatgcaggcgtttccaggtgctttccctaatgcggaagtagtgggtaacccggtgcgtaccgatgtgttggcgctgccgttgccgcagcaacgtttggctggacgtgaaggtccggttcgtgtgctggtagtgggtggttctcagggcgcacgcattcttaaccagacaatgccgcaggttgctgcgaaactgggtgattcagtcactatctggcatcagagcggcaaaggttcgcaacaatccgttgaacaggcgtatgccgaagcggggcaaccgcagcataaagtgacggaatttattgatgatatggcggcggcgtatgcgtgggcggatgtcgtcgtttgccgctccggtgcgttaacggtgagtgaaatcgccgcggcaggactaccggcgttgtttgtgccgtttcaacataaagaccgccagcaatactggaatgcgctaccgctggaaaaagcgggcgcagccaaaattatcgagcagccacagcttagcgtggatgctgtcgccaacaccctggccgggtggtcgcgagaaaccttattaaccatggcagaacgcgcccgcgctgcatccattccggatgccaccgagcgagtggcaaatgaagtgagccgggttgcccgggcgtaattgtagcgatgccttttgcatcgtatgaatttaagaagttaatggcgtaaagaatgaatacacaacaattggcaaaactgcgttccatcgtgcccgaaatgcgtcgcgttcggcacatacattttgtcggcattggtggtgccggtatgggcggtattgccgaagttctggccaatgaaggttatcagatcagtggttccgatttagcgccaaatccggtcacgcagcagttaatgaatctgggtgcgacgatttatttcaaccatcgcccggaaaacgtacgtgatgccagcgtggtcgttgtttccagcgcgatttctgccgataacccggaaattgtcgccgctcatgaagcgcgtattccggtgatccgtcgtgccgaaatgctggctgagttaatgcgttttcgtcatggcatcgccattgccggaacgcacggcaaaacgacaaccaccgcgatggtttccagcatctacgcagaagcggggctcgacccaaccttcgttaacggcgggctggtaaaagcggcgggggttcatgcgcgtttggggcatggtcggtacctgattgccgaagcagatgagagtgatgcatcgttcctgcatctgcaaccgatggtggcgattgtcaccaatatcgaagccgaccacatggatacctaccagggcgactttgagaatttaaaacagacttttattaattttctgcacaacctgccgttttacggtcgtgcggtgatgtgtgttgatgatccggtgatccgcgaattgttaccgcgagtggggcgtcagaccacgacttacggcttcagcgaagatgccgacgtgcgtgtagaagattatcagcagattggcccgcaggggcactttacgctgctgcgccaggacaaagagccgatgcgcgtcaccctgaatgcgccaggtcgtcataacgcgctgaacgccgcagctgcggttgcggttgctacggaagagggcattgacgacgaggctattttgcgggcgcttgaaagcttccaggggactggtcgccgttttgatttcctcggtgaattcccgctggagccagtgaatggtaaaagcggtacggcaatgctggtcgatgactacggccaccacccgacggaagtggacgccaccattaaagcggcgcgcgcaggctggccggataaaaacctggtaatgctgtttcagccgcaccgttttacccgtacgcgcgacctgtatgatgatttcgccaatgtgctgacgcaggttgataccctgttgatgctggaagtgtatccggctggcgaagcgccaattccgggagcggacagccgttcgctgtgtcgcacaattcgtggacgtgggaaaattgatcccattctggtgccggatccggcgcgggtagccgagatgctggcaccggtattaaccggtaacgacctgattctcgttcagggggctggtaatattggaaaaattgcccgttctttagctgaaatcaaactgaagccgcaaactccggaggaagaacaacatgactgataaaatcgcggtcctgttgggtgggacctccgctgagcgggaagtttctctgaattctggcgcagcggtgttagccggactgcgtgaaggcggtattgacgcgtatcctgtcgacccgaaagaagtcgacgtgacgcaactgaagtcgatgggctttcagaaagtgtttatcgcgctacacggtcgcggcggtgaagatggtacgctgcaggggatgctcgagctgatgggcttgccttataccggaagcggagtgatggcatctgcgctttcaatggataaactacgcagcaaacttctatggcaaggtgccggtttaccggtcgcgccgtgggtagcgttaacccgcgcagagtttgaaaaaggcctgagcgataagcagttagcagaaatttctgctctgggtttgccggttatcgttaagccgagccgcgaaggttccagtgtgggaatgtcaaaagtagtagcagaaaatgctctacaagatgcattaagattggcatttcagcacgatgaagaagtattgattgaaaaatggctaagtgggccggagttcacggttgcgatactcggtgaagaaattttaccgtcaatacgtattcaaccgtccggaaccttctatgattatgaggcgaagtatctctctgatgagacacagtatttctgccccgcaggtctggaagcgtcacaagaggccaatttgcaggcattagtgctgaaagcatggacgacgttaggttgcaaaggatggggacgtattgacgttatgctggacagcgatggacagttttatctgctggaagccaatacctcaccgggtatgaccagccacagcctggtgccgatggcggcacgtcaggcaggtatgagcttctcgcagttggtagtacgaattctggaactggcggactaatatgtcgcaggctgctctgaacacgcgaaacagcgaagaagaggtttcttctcgccgcaataatggaacgcgtctggcggggatccttttcctgctgaccgttttaacgacagtgttggtgagcggctgggtcgtgttgggctggatggaagatgcgcaacgcctgccgctctcaaagctggtgttgaccggtgaacgccattacacacgtaatgacgatatccggcagtcgatcctggcattgggtgagccgggtacctttatgacccaggatgtcaacatcatccagacgcaaatagaacaacgcctgccgtggattaagcaggtgagcgtcagaaagcagtggcctgatgaattgaagattcatctggttgaatatgtgccgattgcgcggtggaatgatcaacatatggtagacgcggaaggaaataccttcagcgtgccgccagaacgcaccagcaagcaggtgcttccaatgctgtatggcccggaaggcagcgccaatgaagtgttgcagggctatcgcgaaatggggcagatgctggcaaaggacagatttactctgaaggaagcggcgatgaccgcgcggcgttcctggcagttgacgctgaataacgatattaagctcaatcttggccggggcgatacgatgaaacgtttggctcgctttgtagaactttatccggttttacagcagcaggcgcaaaccgatggcaaacggattagctacgttgatttgcgttatgactctggagcggcagtaggctgggcgcccttgccgccagaggaatctactcagcaacaaaatcaggcacaggcagaacaacaatgatcaaggcgacggacagaaaactggtagtaggactggagattggtaccgcgaaggttgccgctttagtaggggaagttctgcccgacggtatggtcaatatcattggcgtgggcagctgcccgtcgcgtggtatggataaaggcggggtgaacgacctcgaatccgtggtcaagtgcgtacaacgcgccattgaccaggcagaattgatggcagattgtcagatctcttcggtatatctggcgctttctggtaagcacatcagctgccagaatgaaattggtatggtgcctatttctgaagaagaagtgacgcaagaagatgtggaaaacgtcgtccataccgcgaaatcggtgcgtgtgcgcgatgagcatcgtgtgctgcatgtgatcccgcaagagtatgcgattgactatcaggaagggatcaagaatccggtaggactttcgggcgtgcggatgcaggcaaaagtgcacctgatcacatgtcacaacgatatggcgaaaaacatcgtcaaagcggttgaacgttgtgggctgaaagttgaccaactgatatttgccggactggcatcaagttattcggtattgacggaagatgaacgtgaactgggtgtctgcgtcgtcgatatcggtggtggtacaatggatatcgccgtttataccggtggggcattgcgccacactaaggtaattccttatgctggcaatgtcgtgaccagtgatatcgcttacgcctttggcacgccgccaagcgacgccgaagcgattaaagttcgccacggttgtgcgctgggttccatcgttggaaaagatgagagcgtggaagtgccgagcgtaggtggtcgtccgccacggagtctgcaacgtcagacactggcagaggtgatcgagccgcgctataccgagctgctcaacctggtcaacgaagagatattgcagttgcaggaaaagcttcgccaacaaggggttaaacatcacctggcggcaggcattgtattaaccggtggcgcagcgcagatcgaaggtcttgcagcctgtgctcagcgcgtgtttcatacgcaagtgcgtatcggcgcgccgctgaacattaccggtttaacggattatgctcaggagccgtattattcgacggcggtgggattgcttcactatgggaaagagtcacatcttaacggtgaagctgaagtagaaaaacgtgttacagcatcagttggctcgtggatcaagcgactcaatagttggctgcgaaaagagttttaatttttatgaggccgacgatgattacggcctcaggcgacaggcacaaatcggagagaaactatgtttgaaccaatggaacttaccaatgacgcggtgattaaagtcatcggcgtcggcggcggcggcggtaatgctgttgaacacatggtgcgcgagcgcattgaaggtgttgaattcttcgcggtaaataccgatgcacaagcgctgcgtaaaacagcggttggacagacgattcaaatcggtagcggtatcaccaaaggactgggcgctggcgctaatccagaagttggccgcaatgcggctgatgaggatcgcgatgcattgcgtgcggcgctggaaggtgcagacatggtctttattgctgcgggtatgggtggtggtaccggtacaggtgcggcaccagtcgtcgctgaagtggcaaaagatttgggtatcctgaccgttgctgtcgtcactaagcctttcaactttgaaggcaagaagcgtatggcattcgcggagcaggggatcactgaactgtccaagcatgtgaactctctgatcactatcccgaacgacaaactgctgaaagttctgggccgcggtatctccctgctggatgcgtttggcgcagcgaacgatgtactgaaaggcgctgtgcaaggtatcgctgaactgattactcgtccgggtttgatgaacgtggactttgcagacgtacgcaccgtaatgtctgagatgggccacgcaatgatgggttctggcgtggcgagcggtgaagaccgtgcggaagaagctgctgaaatggctatctcttctccgctgctggaagatatcgacctgtctggcgcgcgcggcgtgctggttaacatcacggcgggcttcgacctgcgtctggatgagttcgaaacggtaggtaacaccatccgtgcatttgcttccgacaacgcgactgtggttatcggtacttctcttgacccggatatgaatgacgagctgcgcgtaaccgttgttgcgacaggtatcggcatggacaaacgtcctgaaatcactctggtgaccaataagcaggttcagcagccagtgatggatcgctaccagcagcatgggatggctccgctgacccaagagcagaagccggttgctaaagtcgtgaatgacaatgcgccgcaaactgcgaaagagccggattatctggatatcccagcattcctgcgtaagcaagctgattaagaattgactggaatttgggtttcgattctctttgtgctaaactggcccgccgaatgtatagtacacttcggttggataggtaatttggcgagataatacgatgatcaaacaaaggacacttaaacgtatcgttcaggcgacgggtgtcggtttacataccggcaagaaagtcaccctgacgttacgccctgcgccggccaacaccggggtcatctatcgtcgcaccgacttgaatccaccggtagatttcccggccgatgccaaatctgtgcgtgataccatgctctgtacgtgtctggtcaacgagcatgatgtacggatttcaaccgtagagcacctcaatgctgctctcgcgggcttgggcatcgataacattgttatcgaagttaacgcgccggaaatcccgatcatggacggcagcgccgctccgtttgtatacctgctgcttgacgccggtatcgacgagttgaactgcgccaaaaaatttgttcgcatcaaagagactgttcgtgtcgaagatggcgataagtgggctgaatttaagccgtacaatggtttttcgctggatttcaccatcgattttaaccatccggctattgattccagcaaccagcgctatgcgatgaacttctccgctgatgcgtttatgcgccagatcagccgtgcgcgtacgttcggtttcatgcgtgatatcgaatatctgcagtcccgtggtttgtgcctgggcggcagcttcgattgtgccatcgttgttgacgattatcgcgtactgaacgaagacggcctgcgttttgaagacgaatttgtgcgtcacaaaatgctcgatgcgatcggtgacttgttcatgtgtggtcacaatattattggtgcatttaccgcttataaatccggtcatgcactgaataacaaactgctgcaggctgtcctggcgaaacaggaagcctgggaatatgtgaccttccaggacgacgcagaactgccgttggccttcaaagcgccttcagctgtactggcataacgacatttatactgtcgtataaaattcgactggcaaatctggcactctctccggccaggtgaaccagtcgtttttttttgaattttataagagctataaaaaacggtgcgaacgctgttttcttaagcacttttccgcacaacttatcttcattcgtgctgtggactgcaggctttaatgataagatttgtgcgctaaatacgtttgaatatgatcgggatggcaataacgtgagtggaatactgacgcgctggcgacagtttggtaaacgctacttctggccgcatctcttattagggatggttgcggcgagtttaggtttgcctgcgctcagcaacgccgccgaaccaaacgcgcccgcaaaagcgacaacccgcaaccacgagccttcagccaaagttaactttggtcaattggccttgctggaagcgaacacacgccgcccgaattcgaactattccgttgattactggcatcaacatgccattcgcacggtaatccgtcatctttctttcgcaatggcaccgcaaacactgcccgttgctgaagaatctttgcctcttcaggcgcaacatcttgcattactggatacgctcagcgcgctgctgacccaggaaggcacgccgtctgaaaagggttatcgcattgattatgcgcattttaccccacaagcaaaattcagcacgcccgtctggataagccaggcgcaaggcatccgtgctggccctcaacgcctcacctaacaacaataaacctttacttcattttattaactccgcaacgcggggcgtttgagattttattatgctaatcaaattgttaactaaagttttcggtagtcgtaacgatcgcaccctgcgccggatgcgcaaagtggtcaacatcatcaatgccatggaaccggagatggaaaaactctccgacgaagaactgaaagggaaaaccgcagagtttcgtgcacgtctggaaaaaggcgaagtgctggaaaatctgatcccggaagctttcgccgtggtacgtgaggcaagtaagcgcgtctttggtatgcgtcacttcgacgttcagttactcggcggtatggttcttaacgaacgctgcatcgccgaaatgcgtaccggtgaaggaaaaaccctgaccgcaacgctgcctgcttacctgaacgcactaaccggtaaaggcgtgcacgtagttaccgtcaacgactacctggcgcaacgtgacgccgaaaacaaccgtccgctgtttgaattccttggcctgactgtcggtatcaacctgccgggcatgccagcaccggcaaagcgcgaagcttacgcagctgacatcacttacggtacgaacaacgaatacggctttgactacctgcgcgacaacatggcgttcagccctgaagaacgtgtacagcgtaaactgcactatgcgctggtggacgaagtggactccatcctgatcgatgaagcgcgtacaccgctgatcatttccggcccggcagaagacagctcggaaatgtataaacgcgtgaataaaattattccgcacctgatccgtcaggaaaaagaagactccgaaaccttccagggcgaaggccacttctcggtggacgaaaaatctcgccaggtgaacctgaccgaacgtggtctggtgctgattgaagaactgctggtgaaagagggcatcatggatgaaggggagtctctgtactctccggccaacatcatgctgatgcaccacgtaacggcggcgctgcgcgctcatgcgctgtttacccgtgacgtcgactacatcgttaaagatggtgaagttatcatcgttgacgaacacaccggtcgtaccatgcagggccgtcgctggtccgatggtctgcaccaggctgtggaagcgaaagaaggtgtgcagatccagaacgaaaaccaaacgctggcttcgatcaccttccagaactacttccgtctgtatgaaaaactggcggggatgaccggtactgctgataccgaagctttcgaatttagctcaatctacaagctggataccgtcgttgttccgaccaaccgtccaatgattcgtaaagatctgccggacctggtctacatgactgaagcggaaaaaattcaggcgatcattgaagatatcaaagaacgtactgcgaaaggccagccggtgctggtgggtactatctccatcgaaaaatcggagctggtgtcaaacgaactgaccaaagccggtattaagcacaacgtcctgaacgccaaattccacgccaacgaagcggcgattgttgctcaggcaggttatccggctgcggtgactatcgcgaccaatatggcgggtcgtggtacagatattgtgctcggtggtagctggcaggcagaagttgccgcgctggaaaatccgaccgcagagcaaattgaaaaaattaaagccgactggcaggtacgtcacgatgcggtactggaagcaggtggcctgcatatcatcggtaccgagcgtcacgaatcccgtcgtatcgataaccagttgcgcggtcgttctggtcgtcagggggatgctggttcttcccgtttctacctgtcgatggaagatgcgctgatgcgtatttttgcttccgaccgagtatccggcatgatgcgtaaactgggtatgaagccaggcgaagccattgaacacccgtgggtgactaaagcgattgccaacgcccagcgtaaagttgaaagccgtaacttcgacattcgtaagcaactgctggaatatgatgacgtggctaacgatcagcgtcgcgccatttactcccagcgtaacgaactgttggatgtcagcgatgtgagcgaaaccattaacagcattcgtgaagatgtgttcaaagcgaccattgatgcctacattccaccacagtcgctggaagaaatgtgggatattccggggctgcaggaacgtctgaagaacgatttcgacctcgatttgccaattgccgagtggctggataaagaaccagaactgcatgaagagacgctgcgtgacggcattctggcgcagtccatcgaagtgtatcagcgtaaagaagaagtggttggtgctgagatgatgcgtcacttcgagaaaggcgtcatgctgcaaacgcttgactccctgtggaaagagcacctggcagcgatggactatctgcgtcagggtatccacctgcgtggctacgcacagaaagatccgaagcaggaatacaaacgtgaatcgttctccatgtttgcagcgatgctggagtcgttgaaatatgaagttatcagtacgctgagcaaagttcaggtacgtatgcctgaagaggttgaggagctggaacaacagcgtcgtatggaagccgagcgtttagcgcaaatgcagcagcttagccatcaggatgacgactctgcagccgcagctgcactggcggcgcaaaccggagagcgcaaagtaggacgtaacgatccttgcccgtgcggttctggtaaaaaatacaagcagtgccatggccgcctgcaataaaagctaactgttgaagtaaaaggcgcaggattctgcgccttttttataggtttaagacaatgaaaaagctgcaaattgcggtaggtattattcgcaacgagaacaatgaaatctttataacgcgtcgcgcagcagatgcgcacatggcgaataaactggagtttcccggcggtaaaattgaaatgggtgaaacgccggaacaggcggtggtgcgtgaacttcaggaagaagtcgggattaccccccaacatttttcgctatttgaaaaactggaatatgaattcccggacaggcatataacactgtggttttggctggtcgaacgctgggaaggggagccgtggggtaaagaagggcaacccggtgagtggatgtcgctggtcggtcttaatgccgatgattttccgccagccaatgaaccggtaattgcgaagcttaaacgtctgtaggtcagataaggcgttttcgccgcatccgacattcgcacacgatgcctgatgcgacgctggcgcgtcttatcaggcctaaagggatttctaactcattgataaatttgtttttgtaggtcggataaggcgttcacgccgcatccgacatttgcacaagatgcctgatgcgacgctgtccgcgtcttatcaggcctacgtgcggcatcagacaaatgtcactgctttggttcttcgctccagtcatcgctttcggaaagatcgccactgctggggattcgtttttcttcagcagcccattctccgaggtcgatcag

SEQ ID NO: 3 - DNA, 17045 bp, Escherichia coli
gatcaagcacgagacgctggcgaacaggaaggtaaacatgattaatcaattgatctactgggtactctcgacccagtgaaataattctcgcgcgtagtttggcaggattagccatgcgaagaattgacatcatctcttcttgcaggcggctccagtcatcttccgtatcctggctggtggtttccagtaatgctttaactttgcctacagggacgccattacttatccaacgcttgatctcttcgatgcgttgtatgtcttcttcatcaaagagtcggtgtccgccttcactgcgctgtggttttaacaaaccgtagcggcgttgccaggcccggagagtgacaggattaatcccgcaacgttcagcaacatcaccaatgctgtaataagccacaattcctccttgcggtcacaaatctccgtcgcctgtacacgacccaataatactttgtacaatatacgctaaaattgtacaaagtataaataagatttcagctaaattggatgaaacattatttttaatgtggattaaatttaaacgtaacgtattcattttcacgatgatttactgaaatcatgtgaaagaatgtgctgaaaattattttttctctggccacgctatggaagggataccattcaatttagctttagcaaacagatctccctgaaacatctcaattcctgcggattcaagccacatccactcttctggtgttgccacgcccatagcactgacttgaatttcaagtgatgtacagcattttatgatcgcctgaataattgcctgccgtggcccacttttatgaacattggtaatcaattcctgactgattttaattctgtcaggctggaagcgtgacaggagtaacaaaccagcaaaacctgcgccaaaatgatcaattgctacactgataccagcagcctttagcgatttaatcgcttcggcaaactcatcaaaccgagatatgacttcactttcagtaaattcaacgatgatttgttcaggcaccagagcattggcctttatttcattaagtaaaaaagagactgcgtcaggttcgttaaccagggtcataggtaatagattgattgaaatcattttatcaccgagctcaagtgcgtgtgccatcgtgaatgcaagcgccttacttttgagatccgctgtgtagatttccccgtctttacgctgcccaaccgctatggctgatgggctatcttcatttttttgcacaatggcttcaaaagcgattatccgccgcgataagggatcgacaataggatgaaaggcaaagtggtcgtttatagttggtgaaagggcacaggaatcaagttctttatcagatccgtcagcgataaaaagccaggagtcttcggcagggatctcgaaataggttgattgttcggttgcaaggacaaaagtacgaaaaaattgtagcgctctgtcatcataagttagctgaaattttgatgtgcctttgtcgaatacggcctgtaaaacgtcatctcgctcgtgcaggcgcaaatcaaataattccattcccgctttgccaaaacggcgagcaggcgcgtaatcgcacagcagctcaacaatattatagtgccgtggatcctggcatatagcccgatatatcattttaacctgttcttccggaccttccagaagctggaaaaaatgagaaccattaaacagtaagatccctgttacgtcagactgcatgttcctgcgatttgctatcgaaaccatttcttcgatttttttgacaggttcgtcgtcacgtatatggctacgataaataagggtggtaagcattaacaatccagggtaatgggtgaggcgagagtaagacggtaacagacatatcttcttgtgtctttcttttaataccaaaacataaccgtttctttacattgataaaaaatggaaaaagttgaacactagttggcgaaaaatcttgtatagattgtcagttaaatgatgcaatatgttttatcataacacattgttttatatgcattagcactaattgcaaaaaattaatttatcattctgtacacatatttcgtacaagtttgctattgttacttcacttaacattgattaacatttttaacagaggcgtagcatgcatcaaaattcagtgactttagattctgcgggagcaatcactcgttactttgcaaaagctaacttgcatactcagcaggaaactctcggggaaattgtgactgagattttgaaagatggacgtaatctgagtcgaaagtcgctttgtgccaaacttctttgccgactggaacacgcgactggggaagaggaacagaaacattataatgcactaattgggttgctttttgaataatgcaacagcctgattatttaacaggttagctatgaagtcgttatgaagacatctgataatgaacgtataaaatatgaaattactggccaggcggtgctccagatactgcgcatgaagataaatttttcattgcagactcttattaagcaattactcgtaatgaaatcggctgaggaagatgctttccgacgcgatttaattgacagcataattcgtgattttagcaatagtgattcaggagggccaaaccgaagaacagcgacagctgacaataaaagtatgttcaatggtaagaaaataaacagaatacattaaaatttcataagtaagatgagaggttaccatgcttgaagatactacaattcataatgcaataactgataaagcgttagcaagttactttcgcagttcgggtaatttgttagaagaagaatcagcagtgttagggcaggctgtcaccaatttaatgctttcaggcgataatgttaataataaaaatattatcttaagtctgatacactccttggaaacaacaagtgatattctcaaagctgatgtgattagaaaaacactggaaatcgtgttgcgatacacagctgatgatatgtaacttctaattattaagtataagtttatagaaaactcattcatcttatttttgtctgtcgctttagactatacacagcataattttattgggttaatatttctacgaggctgacatgaataattcaatcccagagagatttatttttcaatgtgctttgtttaaaaatctcgagagggaggtgttcatgacgcatgggtatgttgatagtcatattattgatcaggctttacgcttgcgtttaaaagatgaaaccagtgtgattctttctgatctctatctgcaaatattgcagtacattgaaatgcataagactacactaacggatatcattattaatgacagggaatccgtgctctcttagaacttgagtaaggttttagaataaacatcagctgtatcaccatgctgatgcaaagtgagcatttcaggcgttatgctttcttattatgtccgcaatatcaggtgtcaagaatggagagttctcgctctccattcttgacgcctgatatcccgcctaacttattttgtactgcctacattatgctcaataattaatgggttagatcaagatggagaaaattttatcttcggcgtggatatttcttatgctctctaccatgctctctgtagatgccagcgcgagcgaatgaatggcattttcatgtattaaaccctttggccgggacaagcaaatgcgcaatacactcatacccatcctcgttgcgatatgcttgtttattaccggtgtcgctattttgaacatccagctctggtattccgcaaaagcagagtacctggcgggagcgagatatgccgccaacaatatcaatcatatacttgaagaagcgtcacaagcgactcaaacagcggttaacattgccgggaaggaatgcaacctcgaggagcaatatcagcttggcactgaagcagctctgaaacctcacctgcgcacaatcatcattctcaaacagggaatagtctggtgtacatccctgcctgggaatcgggtcctgttgtctcgtattcctgttttcccggacagtaatttactgttggctccagcaatcgacaccgttaatagattacctatcctgctctatcagaaccaatttgcagatacgcgcattttggttacgataagcgatcagcatattcgtggggcacttaatgtacccttgaaaggggtaaggtatgtattacgcgtggcggatgacattattggaccaacgggtgatgtgatgacgcttaatggacattatccctataccgagaaggttcactccacaaaatatcatttcactattatctttaacccgccgccactctttagcttctacagacttatcgataaaggctttgggattttaatatttattctgttaatcgcctgcgccgctgccttcctgcttgatagatatttcaataaaagcgcaacgcctgaagagatcctgcgacgggcaataaataatggggagatcgtccctttttaccaacctgtggtaaatggtcgggaagggacattgcggggagttgaggtgttagcccgctggaaacaacctcacggtggatatatatcacccgcggcatttattccacttgctgaaaaatccggattaatcgttccgcttacgcaaagcctgatgaatcaggttgccagacagatgaacgctatcgcgagtaaattgccggaaggttttcatattggaattaattttagcgcttcgcatattatttcgccgacgtttgtcgacgagtgtttaaatttccgtgacagttttacccgccgcgatttaaaccttgttctggaagtcaccgagcgtgagccattgaatgttgatgaaagtctggttcagcggttgaacatactgcatgaaaatggttttgtcatcgcactggatgatttcggtactggctactcagggctttcttatcttcatgacctgcatattgattatatcaaaattgatcacagtttcgttggccgcgtaaacgcagacccagaatcaacccgaattctggattgtgtattggatctggcgcgtaaactttcgatcagtatcgtcgctgaaggtgtcgaaacgaaagaacaacttgactatctgaaccaaaattatatcacatttcagcagggttattatttctataaacctgttacatacatcgacctggtcaaaattatcctttctaaaccgaaggtgaaggttgtggttgagtgaaaattgatcagtaaggccatagtgcggtgtaattatagacagctaattagctcgttgcctcttgttactattgttcattattttgtttgctataattgtttgaaagttttgacaggattgccattagtagcatgaacaatagtaataatctggattatttcactctctatatcatattttccattgcatttatgctgatcaccctcctggtcatccttattgcaaaacccagtaccgggctgggagaagtgcttgtgacgataaatttgcttaatgcccttgtttggctggcgatcaatctggttaatcgattaagagaaagactcgtcaaccacagggatcagcaataatctttcagtttctcactgtcagtatgcggctgaatgggttgctggcagtgaacgcctggatcattgaaggaaaggcattattgcgcaaatagttgtcaaccctggtgttatcacggttgtttttatatatcaccgaaataatcctcatcgcaactattaacaattttgatgtcgaagagttatttgttaaacaaaatcgtcacctcaaagtgatcaatgtcatgaaaataaggtgaaaaatgataatgccgacttatttatcatttatatattgtcgctgtttatctatttaaattttttgtgcttttgtttttgtctttaccctccgttttggtaatctgagctcataggttatttgaccaggaatgtttgttaatccaatgaatggatggttaatctatgaaactgaaaaaactccccgggtttagtttgggacttattgctctggcggtgggtaatgcatatgcaacacaattgttggatgattatagtataatttcctatatgactgatgaagaatcgccgattgaaatcaaagataataatccgataagtaatggagagtatctaaccactgaagacgaaagccatgctgtgaaagtggatgacggtgtaactggatatataaataatgccagtgtgatgactagtggtgatggatcttatggtatttctgttgatagtcaaaacaaagtattatatataagcgatagcgatattaagacctctggaagcgtatctgacaaagaaaatggagggataacagccagcgcagtagtcagtgaatttggtggcaccatctttatgaatggtgataattcagtcgagtcgggtggggcatattcagcgggacttttaagccaggttaatgattctgaaaagatggtaaataacacccgtcttgaaaccacagataaaacgaacattgttacctctggggaaaatgcagtaggtgttcttgcatgttcaagtcctggagagtctcgaacatgtgtcgatgctgtagatgatgaagttagtgattctaacagttacgaagttattagccgtgctgatttaaaaatgaatggtggttccataacaactaatggcattaatagctatggtgcttatgctaatgggaaaaaagcatatattaatttagattatgtggcacttgaaactgtggctgatggaagttatgcagttgctattcgacaaggtaacattgatataaaaaatagttctattacaacaacaggcactaaagcccccattgcaaaaatatacaatggtggagagttatttttttccaatgtcaccgcggtatcaaaacaagataaaggaatatcaattgatgcatcaaatatcgattctcaagccaaaatagcactattaagtgttgaactttcaagtgctttggatagtattgatgttaacaaaactacaacggatgtaagtatccttaatcgaagtattatcacacctggtaataatgttctggttaataatactggaggtgacttaaacataatttcgtccgactctattctaaatggagcgactaaactcgtcagcggcacaaccacgctgaagctttcagaaaatacaatctggaatatgaaagatgactccgttgttacccatctgactaattcagacagtattatcaatctttcgtatgatgatggtcaaacatttacccaaggaaaaacattaaccgtaaaaggtaattatgtcggtaataatggtcagcttaatatccgcaccgtattaggtgatgataaatcggctacggacagacttattgttgagggtaatacttcgggttcaactaccgtctatgtgaaaaatgctggaggaagcggcgcggccacgctaaacgggatcgaactcataactgtgaatggcgatgaatctccagcagatgccttcagataaggtgatgcaaggattgcagctggagctttcgaatatcaactaaaacaacaaggcaaaaactggtatttgacaagttatcagtcagtgaatgaggaggataacagctcagagggaaattcagaatcaacagaaacgcctacccccgtcctgcgccccgaagctggaagttacgtcgctaacctggcagctgctaacactctttttgttatgcgtctgaacgaccgtgcgggtgaaacgcgctacatcgatcctgtaactgaacaggagcgttcaagccgactttggctacgtcaaattggcgggcataatgcctggcgtgacagcaacggacagttgagaacgacctcgcatcgctacgtctcgcagttagggggcgatctgttaaccggtggttttaccgatagtgacagttggcgtttgggagtgatggctggttatgcccgcgactacaacttaactcattccagcgtgtcggattatcgttcgaaagggagtgtcagaggctatagcgcagggctgtatgccacctggtttgccgatgacatcagtaaaaaaggcgcatacattgactcctgggcgcaatatagctggtttaaaaactcggtgaaaggggatgaattagcctatgaatcctatagcgcgaaaggtgcaaccgtctcgctggaagcgggttacggttttgccctgaataaatcctttggtctggaagcggcgaaatatacgtggatcttccagccacaggcacaggctatctggatgggcgtcgatcataatgcgcacacggaagccaatggctcacgtattgagaatgacgcaaataacaacatccagacccgactcggcttccgcacctttattcgtactcaggagaaaaacagcggtccgcacggtgacgactttgaaccttttgttgaaatgaactggatccataacagtaaagattttgctgtctcaatgaacggtgtgaaagtcgaacaagatggggcgagtaatttgggggaaattaaacttggcgtaaatggcaacctgaatccagcggccagcgtctggggaatgtgggcgtgcagctgggtgataatggctacaatgacaccgcagtgatggtgggcctgaaatataagttctgatcccgccgttagctaaaaaaccgcgtcgtattcatcgacgcggtacatatgaaatattattttttgccgatagcacgcatggtgtcatcaattgccgtgatcaacagcatttgcgggtctttagcgcaaacctgattcagtttttctaccactttggcgctcagttccggagattgctcaatttttaaatcacggctggcaacgctggcattacccattaccgcaacaatttctgcaacctgtgcgctgtcagtttttgccatttcgttggcttctgcgcaagtaatataggtttctgacggcaaaccgtttttaatattgtagtcctgcgcccaggtcattggtgcgaaaacaaacaggcccgccagtaaagcaaattttttcatcatcattccttatttcattttacccagaattgcaccacccgtaccgccaatcacggcacctttaatcgccccttcgaggccattgccggtcagaacgccagtgacagcaccaacggcggcacccacttttgcacctttacgcgcatttttaccgtcgcggcctttttctgttactgcaccaacaccagcgccaacagctgcacctttcagtacgccattaacaccattgccagtaagtaaaccaacgcctgcgcctagcaatgcacctttcgtggtgcggttcatatccgccatcgctggcgtggagcagaacaatgctgagataagcccgaaggcaagtatttttttcttcaacttagatgtccggtattaagtaagttgcacacacaataatttcgtcttcaattaagatctgcttaactaaagaacgctcgctattattcagataattcaaaatgagcgtggctgtgatgataggaattatgttttttacgtgaatgagaataatcttaaatgaggaataactcattgattgacaatatttttattcaagaagtgtcattgactgttaacgcaatgttgtaaaggtaagataatctgatttatcaatattattgtgtgatttttatgtgagcagaagatattcatcagcaacgattacattagtcattttattttgccgacggcctcattgtcgaaagataagcgtacgacagtattatcagaaaagagtgattttttatccaactacacttcagcgcactgcgtgtaaaaaatgcctctttcttatgcgggatatcatcatttcatcatgatgtctttggtgagcggtgaacacaatacacctgcgctgtctcttcaggatgaatcccctggtctggtgcctgcgggctgatgttgcagcagagcttaggtcacttagacgctactatcatttatccaatggcatggaatcgaaatcagtcgatacccgcagtatatatcgtgaactgggtgcaacgctgagttacaacatgcgcctggggaacggtatggaaatgaaccctggctgaaggcggctgtgcgcaaagaatttgtcgatgataaccgggtgaaggtgaataatgacggtaatttcgtcaatgatttgtcgggcagacgtggaatataccaggcagctattaaagcctcattcagcagtacgtttagcggacatctcggggtggggtatagccatggtgccggtgtggaatccccgtggaacgcggtggctggtgtgaactggtcgttctgaccatcaacgattaaactgcgcttcggcgcagttttcgtttacaggatgttgaaagggaaaattctggggcaaaaaaagcccgccagttacggcgggaaacctcatcctatgggagaacaatgaataatgaaattgcggggttatcatctcccagtatatccatactaacaataaggttatttactcaaccaggcataaacattttgttttgtgcgtgggaacagccttaaggtgtaaagggggaggtggaaatagcaatgaggagtatcagcaagaatactcgccgctttaccacaacgtggatgagagggatgaaaaactcaaggcagagataactctgccttgaagataaatgcgcttttacagcgggcttatttcagctcttctgcttccggtaaggtcacgttcagctcaagaatagaaatatcgccatctttttgctcaagctgtacggttaccatctcaggatcaatttgtacgtatttacaaatgacctcaagaatatctttacgcaactgcggcagataatgcggttctgcatcgctgcgacggcgttcagcaacaataatctgcagccgttcttttgcaatgttggctgtgtttttcttccgcgagagaaagaaatcgagtaatgccataacttatcctccgaacaagcgtttgaggaagcctttcttctcttcttcaatgaagcggaaaggacgttcttctcccaacagacgttctacggtatctgcgtaggctttacccgcatcggcgttaatgtcgagaatgaccggttcaccctggttagaggcgcgcaatactgattgatcctctgggatcacgccgacgagtttgatgcgcaggatctccagcacatcttccatgctcagcatgtcacctctgcttacgcggcctgggttatagcgcgttaacagcaggtgctctttaataggctcttcgccattttctgcgcggcgtgatttcgacgccagaatgcctaaaatacggtcagagtcgcgtactgaggagacttccgggttggtggtaataatggcttcgtctgcaaaatagagtgccattaacgcaccggtttcaatccctgccggggagtcacaaacgataaattcaaaatccatcgctttcagatcatcaagaactttggcgaccccttcacgggtgagggcatctttatcgcgtgtttgcgatgccggcagaatatagagattttcagtacgcttatctttaattaacgcctgatttagcgttgcatcgccctgaatgacgttgacgaaatcgtaaacgacccggcgttcacaacccataatcaggtcgagattacgcaggccgatatcaaaatctatcacgacagttttctttcccttctgggccaaaccagtggcgatggccgcgctggaggttgtcttaccaacaccccctttgcccgaagtaacaacaataatgcgtgccatagaaattccttgttaaaaagggatcaatttaacggttgaacggtcaaagcgttttcgactaactgcagtcgcgccgctttgccataaaattctgctgggatttgatcactcagccagtattcacctgcgatggacaccagttccgccatcaggttcgtacaaaatatttgcgtttcccggtcaccacttgcccctgccagcgcacgaccgcgcatcatgccatagacatgaatgttcccatcggcaatcaattcggccccagcgctaacgtggcttgtaacaatcagatcacattgtggagcataaatacgctgaccggaacgcaccggggtatctattaaacgcgtttttgtgaccggcgttgtattttgcgctggagcctgcggtgtgggagctggacgtggcgctttttcctttccttccgtcaggataggcagccccatcttttcaatttcggctttaagttgcgcatctttgcagccacttacgccaataacccgcaaaccggttgccgaaaccgccttatgcatcgctgaccagtttaccgggtcttccagtgcactgacgttgagtacaacgggggcatgttttaaaaatgcgggggcctgagcgattttgtcttccagcgcctgatggataaccttaggttctgcctcatgcagatgaaccacagataaagtgaagctactgcctttaagctcgattggcgtgtttgacatcctggccttactcaattagctattaatcatcgccagcgcgcgatgatgttccgaagactataaggcatgttatagtctggattatattgaggcaagtcaccctcccatttattcagagtaaaagtctattctgtgataaatggcgctgattcatagcttaaaaaatacccttgtcaatcaacccattgccgtcgtacttttgattgttcttatttacgcttcctttttccgcaccctaatcgtgacagcatctccagacctgtttaaatatccagtattgaggcaagtgtattttttcaccacgccaggctttcttaactttccattttttgcggcatcattaaagaacagatacccgttatcttaatatccgccacagaattgctctatcatagaaaccgcagaagacgtctgatacttctgtcaggtcatcgtaactcgtccaggtcagcggttttgattacggattgatgatgaaatgagcataagtgttgtacggttggattatcaggatgtgctatgaatatgatgcgtattttttatatcggattgtcaggtgtggggatgatgttctcatcaatggcgtctggaaatgacgctggcggacttcaatctccggcgtgcggcgttgtttgcgacccgtatatttgtgtgaactcagatggcatttccccagagttaacaaggaaatatctcggcgaaaaagccgctgaaaacttacaatcattacaaggctacgatcccagcgaatttacattcgctaacggtgtattttgcgatgttaaagaaaaattatgtcgtgatgatcgttattttggtgtggatggtaagcggagtggaaaaatcaatcaaaccaccacaaagatgttatttatgtgtcgtgagtgatgtcttgtttacattatgttctattcgtcattaacctcttgagcgacagagaggagtggggcattaacgtttatgacggggagagtccccgtcggttgacatttacttaatttgaatatcgacgttatattttttagttttgtttttacgggcgtcgtttcgggtttgcaacactcgcagctcatatttgccagaagcagggagtgagtattgtccgtgactatcgagttctggggaatatctggataaatcaactgaatcatcgattcctggcccgaagaggtaagtatcagcgccttcattagagatactcacatgcactttctgaccttttttggcatagaaggtatatgtatcgtaatcgtatccctttatttcgccggagtactgagcgctgctatggccttttctgaactcaacattgacattcttacccgcagcaaagctcgtggaggttagcagtgcaagcagcaatacagccttcctgatgctcttgattttcattggtagtctcctgttcagaatgagtacgatgaactgttataatataacaatccctaacgggagaattccagtggctttcctgcgttcggtaaaatcacgttgcggcatttttgccggggggattacttataaagggggcatggactcaacaaaccgtagaaatctacagctggctggcttgtggcgcgggtttcattgatgttagcttatgccaaaacctggcatcttaaagagtaaaagtatgttttgtgtgatttatcgaagcagcaagcgtgaccagacctatttatatgtcgaaaaaaaagacgatttttcgcgtgttcctgaggaactgatgaaaggttttggtcagcctcagttagcgatgattctgccgctggatgggcggaagaaactggtcaatgccgatattgaaaaggttaaacaggcattaaccgagcaaggttactatttgcagttaccgccaccacccgaagatttgctgaagcaacatctttccgtcatggggcagaaaacagacgacactaacaaataaccgatatccggcggtggcattatctttgtcggcgcgggttttcatatccacgataaggtgaggggaacgttatgtatcaacatcacaactggcaaggtgcgctgctggattatccggtgagtaaagtagtctgtgttggcagtaactatgccaaacatattaaagagatgggcagcgcagtgcccgaagagccagtgctgtttattaaaccagaaacggcactgtgcgatctgcggcagccattggcgatcccatccgatttcggttcagttcatcatgaagtcgaactggcggtgttgattggcgcgacactgcgtcaggctacggaagagcatgtccgcaaagccattgccggttatggcgtggcgctcgatctgacattgcgtgatgttcagggaaaaatgaagaaagccgggcagccgtgggaaaaggctaaagcgtttgataactcttgtccgctttccgggtttattcccgcggcggaatttaccggcgacccgcaaaatacaacgctgagcctgagcgtaaacggcgaacaacgccagcaaggtacgactgcggacatgatccataaaatcgttccgctgatcgcttatatgagcaagttttttaccctcaaggccggtgacgttgtgttgacaggcacgcctgatggcgtcggcccgttgcaaagcggtgatgagctgacagtcactttcgatgggcattctttgacaactcgcgttttgtaatactttttgccgcctgaaagcggcggcaaaacttgcatcgctgtgccagactggttataaggtgcgttttaacgtaatggcggaacacctgatgagcgatgtacctttctggcaaagtaaaaccctggacgaaatgagcgatgcggaatgggagtcgttgtgtgatggttgcggtcagtgttgcctgcataaactgatggatgaagacaccgacgaaatctacttcactaacgtcgcctgtcgccagctcaatattaaaacctgtcaatgtcggaactacgaacgtcgtttcgagtttgaacccgactgcattaaattaacccgtgaaaatctgccaacattcgaatggctgccaatgacctgcgcttatcgtttgctggcggaaggtaaagatttacctgcgtggcatccgctacttactggttcgaaagcggcaatgcatggtgaacgtatctctgtgcgtcatatcgcagtgaaagaatcagaagtgattgactggcaggatcatatcttaaataaacctgactgggcgcagtgataaatttaatagatgctgatgggggctttcttaatatacgtctggatgctcgccatttcgtagccctgtttttgaaagcgctctgtcataatgagagttacccgataccttattatcaacaggtaactctcaatctttaaaaaacgtctgtgtttttaaatgtgataaaccttataccttgagtacatggagagaataatcgcttatcagacttcaggtacctcaaagagtgtctttttaccgtgtcttttctgatactcattacaggtgttaatcatttttttggccgcttcttttagcaaagaaagcattaaatcatcataatcaacgtagaatctggttgtttcagtttccgtttttatctcaccgatggcggctatttcggtggttaatttcaatttggcggcatcgatatctttattcgcttgtttaaccgtgttagacagggtggtaaagaaattctgcacagattttaacttgttcttcaattctggaatcagttttccttcaactacgcccgcagcaatagaataggaaatgattaatccaaatggaccggcgacgacaccggctgcggcaccggcatatgcttccttcctgattttatctacctgtgactggaaatagctgcttttttctgaaaaatcattggttaactggctatctaacgccagcagtttcccggaagcgttgttgaaactttgtgagcttaccagcagggatttttgcgcttcattcagcttcgtgatgccgtcatccagtaccttaatgagaatgtctttctgggcggatgctttcttctcattgtactcatcaaatagcaaaatatacgctgcgagcaattgcgtcgcaacaccacaccattcatacactgtttgggttgcttcaaaatacttatcctggctatccataagtaaggttttaatatcgccgactaaaacggaggctgcctgtgaatactcctgtttaaagcgacttaactcttttatggtttcatcaaaggtctgccaggggatgacctgatcgagatatttattataaagatctaatgctccatctgcggtttcgattgcgtttttaactacttctaccgttttatctgcaacgatttcagtcataatcattcgcctctttaaatatataaattgtaatgaaactcctgttttacaactattaataaattttacttcatctaattcatagttagccgggcgggatgcgtcaatgtctttatttctattaatatgataaatatcaaacaatgtttaatgtcattatggcgaatgcttctattctattttttagccgggtgatatttttcatttctgctggatgagcgtcgtcgccagaaggccacgtgagcacaagataagagaacgaaaaatcagcagcctatgcagcgacaaatattgatagcctgaatcagtattgatc

SEQ ID NO: 4 - DNA, 16175 bp, Escherichia coli
gatcttgcccagtctgcgaaggatagttggtcagcaacaccagcggcaggcctttatccataatcccgtgcaaaaattccgctgcacccggtacggcgacgttatcgtgcatcagcacgccgtcgatatcgcaaattacatttttaatggtcatggactacccagaatattgacaacaataagcgccactataaaagcacattaattttccagcaaatgctggagcaaaataccgttgagcatggcgcgttttaccagcgcaaaagcgccgattgccgagcggtgatccagctcagaacgtaccaccggcagattagtgcgaaacgccttcagcgcctgggtattaatgcagctttcaatagcagggagcagcactttatcggcttcggtgatttcaccggcaataacaattttttgcggattaaataagttgatagcaatggcgatggttttacccagatgacgaccgacatactcaattacttccgacgccagactatcgcctttgttcgcggctttgcagatagttttgatggtgcagtcgtccagcggcacgcggctctggtagccctgctttaacagattcaacacccgttgttcaatggcagcgttggcagcgatagtttccaggcagccaaagttgccgcagtggcagcgttcacccagcggttcgacctgaatatggccaatttcaccgacgttgccgttgcggccaataaaaatgcgcccgttagagataatcccggccccggttccgcgatggacacgcaccagaatggagtcttcgcaatcctgacttgcaccgaagtagtgctccgccagcgccagactacggatatcgtgaccaacgaaacaggtcactttaaaacgttcttccagagcttctaccagcccccagttttctacctgaatatgcggcatgtaatgaattttgccgctgtccgggtcaacaagccctggcaggatcaccgaaatcgcgatcagctcgcgcagtttgcgctggtagctatcaataaactgagcaatggcattcaacagggcatgttccagcgtttgctgggtacgttccggcagcgggtaatgttcttctgccagcactttgctgctgagatcaaacagagtgatggtggcgtcatgacgaccaagccgtacgccgattgcgtggaaattgcgggtttcggtgacgatggagatagcgcggcggcccccggtggaggcctgctgatcaacttctttgatcagcccgcgttcgataagctgacgcgtaattttggttacgctggcgggggcaagctggctttgctcggcaatctgaatccgcgagattggcccgtactggtcaatcaggcgataaaccgccgcgctgttaagctgttttacgagatcaacattacctatctgagcttgtccgcctggtgtcatactttctcttattgagttacgacctcgttaccgttaacgatggtcttggtgattttaaaatcaggtgtgaatgcagtcaggttggctactttacctgcggcgagtgtgccgagacgtttctcaacgccaatcgcacgcgccggatagagcgtcgccatacgtagcacttcatccagtgcgataccgcaatgttcgaccagattacgcacgccttcaatcatggttaaggatgaaccgcttaacgtaccgttctcatccacacaaagtccgttacggtagtatattgttttacccgcaaaaatgaactgttcaatgttggcacctgctggcgcggtggcgtcagtaaccagacacagtttgtcgcctttcagacgtttagcgttgcgaatgttggcgtaatcaacatgcaggccatcagcaataataccgcaataaatgtcagcttcgtcgaggatcgcgcccgccaggccaggttcacgaccggtaatatacggcatcgcgttgtacagatgggtggcaaaggtaatccccgcgcggaaaccggcttttgcttctttcaacgtcgcgttggagtgaccggcagaaaccacaatcccggcatttgccagtttgctgatgacttccgcaggaaccatttccggtgccagggtcactttggtaatgacgtcggcgttttcacacaggaaatcgaccagcgcggcatcaggcttacgcacaaaattcggattatgggtgcctttttttaccagattcagccacggaccttccagatgcagacctaacgcctgattcggatgttttgccaggtactcgcgcataacgcgcacgccctgtttcatcagctcatcgctggtggtgataagcgtcggcagatagttagtacagcctgatttctcattggctttctgcatgatttccagcgtttccacgctgaccgcttcagcggtgtcgttaaactgtacgccgccgcagccgtttaactgcacatcgataaaaccgggggagagaatggccccgttcagtgaacgttgttcgatctctggcggcagttccgctaccggacagacgcttttaatcaggccatcagcgataacaaccgcgtggtcatcaagaaattcgtggccggtaaagatccggccctgggttaatgcatacattctgacccccgattttaaaaaatattgccctgagcaaggagccagggcagggataacaattacagacctttgatattttctgcttctaattcattgaaatatcttaaagtcttaactttcagctccatggtggaaggttcatcgcacaccatgatcgctttcggatgcagttgcagacagctgatggtccacatatggttcacgcaaccttcaacggcggcctgcagcgccagtgctttctggctacccagcaccagaatcatcacttcttcggcatccagcagtgtaccaacaccgacagtcagggcatattttggcacctgattaacatcgttatcaaagaaacgagagtttgcgacgcgagtgtcatgagtcagggttttgatacgagtacgagaagccagagaagacgccggttcgttaaatgcaatatgaccgtcgttacctacaccgcccataaacagatgaatttttccgtaagaacggattttttcttcatactggcggcactcggcgtcgatatccggggcgttgccgttgagaaggttgatgttttctgctggaatatcaacgtgatcgaagaaattacggtgcataaagctgtagtagctttccggatgctctttcggcagaccgacatattcgtccatgttgaaggtgacaacgtgcttaaagctgacctggcctgctttatgcatttcgactaacgctttataggtggtcatcggcgtgccgccagtcggcaggcccagtacaaacggacgatcggcagtcggtttgaacgcattgatacgattgacgatatggcgagcagcccatttgccgacctgttcagcggtagtcagggggatcagtctcattattcacctcaataagtaaaatgtaagccgttggcggattaggcatctttaagcgtaacctggatttgcgcagacaggcgtcaatccgacctgattttttgaatgataaaataagttttctggtttagccagtaaaagggagtgataataacgatatttggtgacaaaactcacaaaagacacgcgtttaatttgcgatacgaattaaattttcacacactctgtagcagatgatctaacaatctgattacagaacatcggcagtacaatttgcagcaaaataaaaatacggcttgaaacgagccaaatagggttctcgtagggggaataagatgaatattttaggttttttccagcgactcggtagggcgttacagctccctatcgcggtgctgccggtggcggcactgttgctgcgattcggtcagccagatttacttaacgttgcgtttattgcccaggcgggcggtgcgatttttgataacctcgcattaatcttcgccatcggtgtggcatccagctggtcgaaagacagcgctggtgcggcggcgctggcgggtgcggtaggttactttgtgttaaccaaagcgatggtgaccatcaacccagaaattaacatgggtgtactggcgggtatcattaccggtctggttggtggcgcagcctataaccgttggtccgatattaaactgccggacttcctgagcttcttcggcggcaaacgctttgtgccgattgccaccggattcttctgcctggtgctggcggccatttttggttacgtctggccgccggtacagcacgctatccatgcaggcggcgagtggatcgtttctgcgggcgcgctgggttccggtatctttggtttcatcaaccgtctgctgatcccaaccggtctgcatcaggtactgaacaccatcgcctggttccagattggtgaattcaccaacgcggcgggtacggttttccacggtgacattaaccgcttctatgccggtgacggcaccgcggggatgttcatgtccggcttcttcccgatcatgatgttcggtctgccgggtgcggcgctggcgatgtacttcgcagcaccgaaagagcgtcgtccgatggttggcggtatgctgctttctgttgctgttactgcgttcctgaccggtgtgactgagccgctggaattcctgttcatgttccttgctccgctgctgtacctcctgcacgcactgctgaccggtatcagcctgtttgtggcaacgctgctgggtatccacgcgggcttctctttctctgcgggggctatcgactacgcgttgatgtataacctgccggccgccagccagaacgtctggatgctgctggtgatgggcgttatcttcttcgctatctacttcgtggtgttcagtttggttatccgcatgttcaacctgaaaacgccgggtcgtgaagataaagaagacgagatcgttactgaagaagccaacagcaacactgaagaaggtctgactcaactggcaaccaactatattgctgcggttggcggcactgacaacctgaaagcgattgacgcctgtatcacccgtctgcgccttacagtggctgactctgcccgcgttaacgatacgatgtgtaaacgtctgggtgcttctggggtagtgaaactgaacaaacagactattcaggtgattgttggcgcgaaagcagaatccatcggcgatgcgatgaagaaagtcgttgcccgtggtccggtagccgctgcgtcagctgaagcaactccggcaactgccgcgcctgtagcaaaaccgcaggctgtaccaaacgcggtatctatcgcggagctggtatcgccgattaccggtgatgtcgtggcactggatcaggttcctgacgaagcattcgccagcaaagcggtgggtgacggtgtggcggtgaaaccgacagataaaatcgtcgtatcaccagccgcagggacaatcgtgaaaatcttcaacaccaaccacgcgttctgcctggaaaccgaaaaaggcgcggagatcgtcgtccatatgggtatcgacaccgtagcgctggaaggtaaaggctttaaacgtctggtggaagagggtgcgcaggtaagcgcagggcaaccgattctggaaatggatctggattacctgaacgctaacgcccgctcgatgattagcccggtggtttgcagcaatatcgacgatttcagtggcttgatcattaaagctcagggccatattgtggcgggtcaaacaccgctgtatgaaatcaaaaagtaatctgctttatgcctgatgcgacgcttgagcgtcgcatccaacaatgacaagcggtggagatcttctctgccgctttttttttcatcaatcatccccataatccttgttagattatcaattttaaaaaactaacagttgtcagcctgtcccgcttataagatcatacgccgttatacgttgtttacgctttgaggaatccacgatgagtgaggcagaagcccgcccgactaactttatccgtcagatcatcgatgaagatctggccagtggtaagcacaccacagtacacacccgtttcccgccggagccgaatggctatctgcatattggccatgcgaaatctatctgcctgaacttcgggatcgcccaggactataaaggccagtgcaacctgcgtttcgacgacactaacccggtaaaagaagatatcgagtatgttgagtcgatcaaaaacgacgtagagtggttaggttttcactggtctggtaacgtccgttactcctccgattattttgatcagctccacgcctatgcgatcgaactgatcaataaaggcctggcgtacgttgatgaactgacgccggaacagatccgcgaataccgcggcaccctgacgcaaccgggtaaaaacagcccgtaccgcgaccgcagcgttgaagagaacctggcgctgttcgaaaaaatgcgtgccggtggttttgaagaaggtaaagcctgcctgcgtgcgaaaatcgacatggcttcaccgtttatcgtgatgcgcgatccggtgctgtaccgtattaaatttgctgaacaccaccagactggcaacaagtggtgcatctacccgatgtacgacttcacccactgcatcagcgatgccctggaaggtattacgcactctctgtgtacgcttgagttccaggacaaccgtcgtctgtacgactgggtactggacaacatcacgattcctgttcacccgcgccagtatgagttctcgcgcctgaatctggaatacaccgtgatgtccaagcgtaagttgaacctgctggtgaccgacaagcacgttgaaggctgggatgacccgcgtatgccgaccatttccggtctgcgtcgtcgtggttacactgcggcttctattcgtgagttctgcaaacgcatcggcgtgaccaagcaggacaacaccattgagatggcgtcgctggaatcctgcatccgtgaagatctcaacgaaaatgcgccgcgcgcaatggcggttatcgatccggtgaaactggttatcgaaaactatcagggcgaaggcgaaatggttaccatgccgaaccatccgaacaaaccggaaatgggcagccgtcaggtgccgtttagcggtgagatttggattgatcgcgccgatttccgcgaagaagctaacaagcagtacaaacgtctggtgctgggtaaagaagtgcgtctgcgtaatgcttatgtgattaaggcagaacgcgtcgagaaagatgccgaaggtaatatcaccaccatcttctgtacttatgacgccgataccttaagcaaagatccggcagatggtcgtaaagtcaaaggtgttattcactgggtgagcgcggcacatgcgctgccggttgaaatccgtttgtatgaccgtctgttcagcgtgcctaacccaggtgctgcggatgatttcctgtcggtgattaacccggaatcgctggtgatcaaacagggctttgctgaaccgtcgctgaaagatgcggttgcgggtaaagcattccagtttgagcgtgaaggttacttctgcctcgatagccgccattctacggcggaaaaaccggtatttaaccgcaccgttgggctgcgtgatacctgggcgaaagtaggcgagtaattttaagtttcgctatgccggatggggcgtttacgtcgcatccggcaaggaacagacaaacagtttcaaacgctaaattgcctgatgcgctacgcttatcaggcctacatgatctctgcaatatattgagtttgcgtgcttttgtaggccggataaggcgttcacgccgcatccggcaagaaacagcaaacaatccaaaacgccgcgttcagcggcgttttttctgcttttcttcgcgaattaattccgcttcgcaatttatccataaaataaatttaaaataacaaaacataattaaataaaatgtaaccgctttcatcttgctggaatttcacgcttttattcttctgcaagcctttcaaccgcaaacttaagccttgtaacaaaaatcatcaaaatatgtgcggttgctcatgttcttacattctggttacagaaagagattgataattcgcgtcgcgaaaaatagtctgttcctgtagtcagcgagacttttctcaacgctacttttttaatttttattttttcgctgttcacctttggtgcagcaatttatacgtcaaagaggattaacccatgcgtacgtttagtggcaaacgtagtacgctggcgctggctatcgccggtgttacagcaatgtcgggctttatggcaatgccggagctcgcgccgaaggattcatcgacgattcaaccttaaccggcggtatctattactggcagcgtgaacgcgaccgtaaagatgttaccgacggcgacaaatacaaaaccaacctttctcactccacctggaatgccaacctcgattttcagtccggttatgctgctgatatgttcggccttgatattgctgcgtttacggcgattgaaatggcggaaaacggcgacagctcccacccgaacgaaatcgcgttttcaaaaagtaataaagcctatgacgaagactggtccggcgacaaaagcggtataagcctgtataaagctgcggccaaatttaaatacggtccggtttgggcgagggcaggttacattcagccaactggtcaaacgctgttagcgccgcactggagctttatgccaggtacttatcagggggcggaagccggggcgaattttgattacggcgatgctggtgcgttgagtttctcctacatgtggaccaacgaatacaaagcgccgtggcatctggaaatggatgagttttatcagaacgataaaaccaccaaagttgattatctgcactcctttggggcgaaatacgacttcaaaaataacttcgtactggaagcggcatttggtcaggcggaagggtatatcgatcaatattttgccaaagccagctacaaatttgatatcgccggtagcccgttaaccaccagctaccagttctacggtacccgagataaagttgacgatcgcagcgtcaacgacctttatgacggcaccgcctggctgcaagcgttgacctttggttaccgggcggctgacgtagtggatttgcgcctcgaaggcacctgggttaaggctgacggtcagcagggatacttcctgcaacgtatgactccaacctacgcttcctcaaacggtcgcctggatatctggtgggataaccgttctgacttcaacgccaacggcgaaaaagcggtcttcttcggtgcgatgtatgacctgaaaaactggaatcttccaggcttcgccatcggcgcttcctacgtttacgcatgggatgctaaacctgcgacctggcagagcaatccggatgcgtactacgacaaaaaccggactattgaagagtctgcctacagcctggatgcggtctataccattcaggacggtcgcgccaaaggcacgatgttcaaactgcatttcaccgaatacgacaaccactccgacatcccaagctggggcggtggttacggcaacatcttccaggatgagcgtgacgtgaaatttatggtaatcgcaccattcaccatcttctgatgcccgacgcggcaggttttgtgcctgccgcacgtttgaggaatttgctatgaaaaaactgattctcatcgccataatggcatcggggctggtagcttgtgcgcaatcaaccgcgccacaggaagacagtcgtctgaaagaggcatacagcgcctgtatcaacaccgcacaaggttcgccagaaaaaattgaagcctgccagagcgtgttaaacgtgctgaagaaagagaaacaacatcagcagtttgccgaccaggaaagtgtacgcgtactggattatcagcagtgtctgcgtgcaacgcaaaccggaaatgatcaggcggtgaaagccgattgtgataaagtctggcaggaaatacgcagtaataacaaataagtgagagctgtaactctcgcttttcttatttcccttgcataaaaaagccaacccgcaggttggcttttctcgttcaggctggcttatttgccttcgtgcgcatgttcatcttcgcggcaatcgccttcggcacagtgaccgtaaagatagagactgtggttagtcaggcgaatgccatgttttgcggcaatttcacgctgacgcgcttcgatggaatcatcactaaattcgataaccttgccgcagtcgaggcagatcaggtgatcgtggtgatgttgctgtgtcagttcaaatacggatttaccgccttcaaaattgtggcgggtgacgataccagcgtcgtcaaactggttcagtacgcgatataccgtagccagaccaatttcttcacccatatcgatcagacgtttgtataaatcttccgcactgacgtgatggttgtccggctcctgaagaacttccaggatttttaaacgaggaagcgttactttcaggccagctttctttagggcggtattgttatcagtcatgcggaatctgtcctgttactaagcggttcacttcattagaagaagtgacagaatttgctcttgagataatgcgtatcattatagaattgccacgcctaaatgaaaaccacaagtccctggcaaatattgttaataaaaacgtggcacagcttacatttacaacggcaaggccacttgaacaccgggacattgtacaggtacaacagcaaaagttacaaatttgtagcaattattttgattggcattatctattaatacggcgtagacatgagtctacgccgcatcacatcaggcattgagaatttcgtcgagatgcaactcttcagaaatctgtttaacccatttttctacacgttcagcggtcagttccggctgacggtcttcgtcgatagccagaccgacaaagtggtcgtcatctgccagaccttttgatgcttcgaaatgatagcccgcagttggccagtgaccaacgatggttgcaccgcgcggttcaatgatgtcgcggatggtgcccaatgcgtcgcagaaatattcggcgtaatcttcctggtcaccacaaccaaacagcgcaaccagtttgccgttgaaatcaatctcttcgagagtcgggaagaagtcatcccagtcacactgcgcttcgccgtaataccaggttgggatgcccagcagcagaatgtcataagcttccagatcttctttgctgctttttgcaatgtcatggacatcggcaacgtctttaccaagctgtttttgaatcatttttgcgatattttcggtattaccggtgtcgctgccgaaaaagatgccagtgatagccatgagtgaaataacctcttgaaacttattgaaatgggggtggaaaattgcccacggataaaggcaatcatagcagaacaggcagtcttgcggaatcagcaaacgagcaggactgcacactgtgctacatgaaagtggaaatttaaacgatgccctgactacgcagcgccgccagttgctgcattaacatctcttcgatcagttcgctacggctcatattgcgcgactccgccagctcgttcagcgcctcgacagcttccgcgttcagcttcagttcgacacgcttaaggccacgtactttgtcgcgttttagctggttgcgtttattaatacgcagctgttcatcgcgcgaaagcggattagttttcggtcgtcccggtcgacgctcgtgcgcgaacagatctaatgtcgtacggtccgtttgttctttggccatgatcttggtgacttcgggggaaacaatcagccaggcctctgcccggatggatagcgcgccataatacatcagcgcgatgagtcacgccaacgcccacgcgcggaaagcgacgcggacgctgggtttttaatcagttgcgttaatcattgagatagcgacggatagcgcgtaataccgcatccggtttttcagcatggacccagtgacccgcgcctgcaatcacatgcgcccgtgcctgtggaaattgagccagtaaatcatcacggtactgctcgctaacatacggagaattgccgccagggataaacagggcagggtgatcccatgccgggattttctcccaacctacaatatgcggatactgatcccacaataccggcacgttaaagcgccactccccgtcaacaaaagatttcagcagaaactgaatcaccccttcttcattaagatgctggcgcattattgctgctgcttgctggcgagtttgtgcgtccgattcactgaccgcgttgatagccgcaaaaatctcatcatgacggcgtacgtgatagtcgaccggcgcgatatcgatcgccaccagtttatcgatgcgatcggaggctagtgcagtaagtgccattaccgctttaccgcccatggagtgaccgataaatgttgctttgtcgatctgctgtgcatccagagtatcaacaagatcctgcgccatcgccgggtaattcattaccggatctctcggtgaaagaccgtggttacgcatatcaacctggatgatattgtgatcgtttaccagatcgcgagccagtacgccaaggttgtcgaggctgccaaacagaccgtggacaagaacgatgggagaattattgtgctggttttgtgcagtttgcgcgcggatattcaatttcatggcaaagttctttttttcgcgttgtcgggttagggtattatgttgaccattgtgccacagggctgcaacaaataaggtttattccgagtttttctgcaagccaggcttgacgctatccgctgccgggatttattcatatactcctggcgacttgtattcagctaagacactgcactggattaagatgaaaacgattgaagttgatgatgaactctacagctatattgccagccacactaagcatatcggcgagagcgcatccgacattttacggcgtatgttgaaattttccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggatgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccgaaacatgtgccaggcacgccgtattgggtgatcaccaacaccaacaccggccgtaaatgcagcatgatcgaacacatcatgcagtcgatgcaattcccggcggaattgattgagaaggtttgcggaactatctaaaacgttgcagacaaaggacaaagcaatggcaatccacaatcgtgcaggccaacctgcacaacagagtgatttgattaacgtcgcccaactgacggcgcaatattatgtactgaaaccagaagcagggaatgcggagcacgcggtgaaattcggtacttccggtcaccgtggcagtgcagcgcgccacagctttaacgagccgcacattctggcgatcgctcaggcaattgctgaagaacgtgcgaaaaacggcatcactggcccttgctatgtgggtaaagatactcacgccctgtccgaacctgcattcatttccgttctggaagtgctggcagcgaacggcgttgatgtcattgtgcaggaaaacaatggcttcaccccgacgcctgccgtttccaatgccatcctggttcacaataaaaaaggtggcccgctggcagacggtatcgtgattacaccgtcccataacccgccggaagatggtggaatcaaatacaatccgccaaatggtggcccggctgataccaacgtcactaaagtggtggaagacagggccaacgcactgctggccgatggcctgaaaggcgtgaagcgtatctccctcgacgaagcgatggcatccggtcatgtgaaagagcaggatctggtgcagccgttcgtggaaggtctggccgatatcgttgatatggccgcgattcagaaagcgggcctgacgctgggcgttgatccgctgggcggttccggtatcgaatactggaagcgtattggcgagtattacaacctcaacctgactatcgttaacgatcaggtcgatcaaaccttccgctttatgcaccttgataaagacggcgcgatccgtatggactgctcctccgagtgtgcgatggcgggcctgctggcactgcgtgataagttcgatctggcgtttgctaacgacccggattatgaccgtcacggtatcgtcactccggcaggtttgatgaatccgaaccactacctggcggtggcaatcaattacctgttccagcatcgtccgcagtggggcaaagatgttgccgtcggtaaaacgctggtttcatctgcgatgatcgaccgtgtggtcaacgacttgggccgtaaactggtagaagtcccggtaggtttcaaatggtttgtcgatggtctgttcgacggcagcttcggctttggcggcgaagagagtgcaggggcttccttcctgcgtttcgacggcacgccgtggtccaccgacaaagacggcatcatcatgtgtctgctggcggcggaaatcaccgctgtcaccggtaagaacccgcaggaacactacaacgaactggcaaaacgctttggtgcgccgagctacaaccgtttgcaggcagctgcgacttccgcacaaaaagcggcgctgtctaagctgtctccggaaatggtgagcgccagcaccctggcaggtgacccgatcaccgcgcgcctgactgctgctccgggcaacggtgcttctattggcggtctgaaagtgatgactgacaacggctggttcgccgcgcgtccgtcaggcacggaagacgcatataagatctactgcgaaagcttcctcggtgaagaacatcgcaagcagattgagaaagaagcggttgagattgttagcgaagttctgaaaaacgcgtaaacacatttaataaaaaaagggcggtcgcaagatcgcccttttttacgtatgacaaacacagaattgcctgatgcgctacgcttatcaggcctacgaggatggtgcaatatattgaatttaagcgattttgtaggccggataaggcgttcacgccgcatccggcaaaaacaacgaacactttgtcaacaaactgagtagctcaaggaaatcccaatgaagaccaacaggagtctggtcgtcatagtgtcactaattaccgccacattactgctgactgcatgcgcccaacctgaacaatcatcattagctggcgactggttactgacccctaaagataaaaccagaggattaacgggtagcattgcggtaaatattgcacctttccggtgtaagacaaattgccgtggtgataacttacctgataatacccgccgctggcagttgtcaggcgggaacgaaaaagaacttacttatcttcataatatgtcagcacaagaaaaggtcggtttaaatcccggttggcaatgctacacctcattttttatgcgggtttgccagggcaagcccggcactcgaccgatagtcaatgaggattatgtcagcgaaagcggattttttggctcgatgatgcatgtcgggattattgagttacgacgctgccagtcagaaaattgccagcaagaattgaaagcgataaatacacattaaaatagtgagtccgggaatgaaacccggacctgaacatgtcttattgcgtgaatgtttctttcatttgatactgcatttcccagagttcagtaagcgaaataacttttcttgttcttgcttcttcactttgtacccataagaaagggtagaacgtgaaggcttccgttgccgataattttattacgtcttctcgccattgctgccatcgtacattttcatagaaggtatctaaatcaccggataatgcccactgaagaaactcagaatatccaacttccagactttcccaattcagcgtatctggcgcaaaataataaacgcagccagtatcttccccaagatcgccaccattaagagcaaaaattacccctgcgacatcgtcagcgatgggtaaagcccgcacgcctgcgaattcagggcgttgtgtccaacttactggatc

SEQ ID NO: 5 - DNA, 1733 bp, Escherichia coli
ggatccagacatcgagctgtgtaaagagccaccagaatgcgccccccatcaacaaaatattgaccagcagcggtaaaataacgaaacgccgaatcccaggttgcgagacgagcttccagccttgcgcaaaatagtaaaaaccgctgcgtggggcagatgtgaatgatgaaaccataatcaggatgagctccttttgaccaatcccaggaaaattctgcgtattttaccgggtaattgcgcaatggacagttaggatatgttcgaaaaaacagcaaaaagcacgatttcatctatctttgtgctgtgaaagttaatagtgcacttgcacttgaggtaatcggcaaatactcttagtgagtaaatgtttgccgtggtggcaaggtgttagaacaacagagaatataatgatgcaggatttgcgtctgatattaatcattgttggcgcgatcgccataatcgctttactggtacatggtttctggaccagccgtaaagaacgatcttctatgttccgcgatcggccattaaaacgaatgaagtcaaaacgtgacgacgattcttatgacgaggatgtcgaagatgatgagggcgttggtgaggttcgtgttcaccgcgtgaatcatgccccggctaacgctcaggagcatgaggctgctcgtccgtcgccgcaacaccagtaccaaccgccttatgcgtctgcgcagccgcgtcaaccggtccagcagccgcctgaagcgcaggtaccgccgcaacatgctccgcatccagcgcagccggtgcagcagcctgcctatcagccgcagcctgaacagccgttgcagcagccagtttcgccacaggtcgcgccagcgccgcagcctgtgcattcagcaccgcaaccggcacaacaggctttccagcctgcagaacccgtagcggcaccacagcctgagcctgtagcggaacctgctccagttatggataaaccgaagcgcaaagaagcggtgattatcatgaacgtcgcggcgcatcacggtagcgagctaaacggtgaagctcttcttaacagcattcaacaagcgggcttcatttttggcgatatgaatatttaccatcgtcatcttagcccggatggcagcggcccggcgttattcagcctggcgaatatggtgaaaccgggaacctttgatcctgaaatgaaggatttcactactccgggtgtcactatctttatgcaggtaccgtcttacggtgacgagctgcagaacttcaagctgatgctgcaatctgcgcagcatattgccgatgaagtgggcggtgtcgtgcttgacgatcagcgccgtatgatgactccgcagaaattgcgcgagtaccaggacatcatccgcgaagtcaaagacgccaacgcctgatacacttaaggcaaattaactcctcttcgaacccccgcttgtcgggggtttttagcattgatggtgcgatatggaatcaatcgaacaacaactgacagaactgcgaacgacgcttcgccatcatgaatatctttatcatgtgatggatgcgccggaaattcccgacgctgaatacgacaggctgatgcgcgaactgcgcgagctggaaaccaaacatccagaactgattacgcctgattcgcctactcaacgtgtaggcgctgcgccgctggcggctttcagccagatacgccatgaagtaccaatgctgtcactggataacgtttttgatgaagaaagctt

SEQ ID NO: 6 - DNA, 2270 bp, Escherichia coli
gatccgttaactacgaaaataggcaacttattcttaaggggcaagattaatttatgttttcccgtcaccaacgacaaaatttgcgaggctctttccgaaaatagggttgatctttgttgtcactggatgtactgtacatccatacagtaactcacaggggctggattgattatgtacacttcaggctatgcacatcgttcttcgtcgttctcatccgcagcaagtaaaattgcgcgtgtctctacggaaaacactacagccgggcttatcagtgaagttgtctatcgcgaagatcagcccatgatgacgcaacttctactgttgccattgttacagcaactcggtcagcaatcgcgctggcaactctggttaacaccgcaacaaaaactgagtcgggaatgggttcaggcatctgggctacccttaacgaaagtaatgcagattagccagctctccccttgccacactgtggagtcaatggttcgcgctttacgcacgggcaattacagtgtggtgatcggttggttggcagatgatttgactgaagaagagcatgctgaacttgttgatgcggcaaatgaaggtaacgctatggggtttattatacatccggtaagcgcatcctctcacgccacgagacaactttccgggctaaaaattcactctaatttgtatcattaagtaaatttaggattaatcctggaactttttttgtcgcccagccaatgctttcagtcgtgactaatttccttgcggaggcttgtctgagcggtttccgcgattctcttctgtaaattgtcgctgacaaaaaagattaaacataccttatacaagacttttttttcatatgcctgacggagttcacacttgtaagttttcaactacgttgtagactttacatcgccaagggtgctcggcataagccgaagatatcggtagagttaatattgagcagatcccccggtgaaggatttaaccgtgttatctcgttggagatattcatggcgtattttggatgataacgaggcgcaaaaaatgaaaaagacagctatcgcgattgcagtggcactggctggtttcgctaccgtagcgcaggccgctccgaaagataacacctggtacactggtgctaaactgggctggtcccagtaccatgatactggtttcatcaacaacaatggcccgacccatgaaaaccaactgggcgctggtgcttttggtggttaccaggttaacccgtatgttggctttgaaatgggttacgactggttaggtcgtatgccgtacaaaggcagcgttgaaaacggtgcatacaaagctcagggcgttcaactgaccgctaaactgggttacccaatcactgacgacctggacatctacactcgtctgggtggcatggtatggcgtgcagacactaaatccaacgtttatggtaaaaaccacgacaccggcgtttctccggtcttcgctggcggtgttgagtacgcgatcactcctgaaatcgctacccgtctggaataccagtggacgaacaacatcggtgacgcacacaccatcggcactcgtccggacaacggcatgctgagcctgggtgtttcctaccgtttcggtcagggcgaggcagctccagtagttgctccggctccagctccggcaccggaagtacagaccaagcacttcactctgaagtctgacgttctgttcaacttcaacaaagcaaccctgaaaccggaaggtcaggctgctctggatcagctgtacagccagctgagcaacttggatccgaaagacggttccgtagttgttctgggttacaccgaccgcatcggttctgacgcttacaaccagggtctgtccgagcgccgtgctcagtctgttgttgattacctgatctccaaaggtatcccggcagacaagatctccgcacgtggtatgggcgaatccaacccggttactggcaacacctgtgacaacgtgaaacagcgtgctgcactgatcgactgcctggctccggatcgtcgcgtagagatcgaagttaaaggtatcaaagacgttgtaactcagccgcaggcttaagttctcgtctggtagaaaaacgctgctgcgggtttttttttgcctttagtaaattgaactgactttcgtcagttattccttacccagcaatgcctgcagatcctgcttcagagaagacattttattcgcgtatttctctttgttttccgcatcttcaatcagctgaacaatcgtttcagaaagcgttttaccgc

SEQ ID NO: 7 - DNA, 92721 bp, Escherichia coli
agccagattttacccgcccatcctaaagaaggggatagtcaaccacatctgaccagcctgcggaaaagtctgctgcttgtccgtccggtgaaagctgatgataaaacacctgttcaggtggaagcccgcgatgataataataaaattctcggtacgttaaccctttatcctccttcatcactaccggatacaatctaccatctggatggtgttccggaaggtggtatcgatttcacacctcataatggaacgaaaaagatcattaatacggtggctgaagtaaacaaactcagtgatgccagcgggagttctattcatagccatctaacaaataatgcactggtggagatccatactgcaaatggtcgttgggtaagagacatttatctgccgcagggacccgaccttgaaggtaagatggttcgctttgtttcgtctgcaggctatagttcaacggttttttatggtgatcgaaaagtcacactctcggtgggtaacactcttctgttcaaatatgtaaatggtcagtggttccgctccggtgaactggagaataatcgaatcacttatgctcagcatatttggagtgctgaactgcctgcgcactggatcgtgcctggtttaaacttggtgattaaacagggcaatctgagcggtcgcctaaatgatatcaagattggagcaccgggtgagctgttgttgcatacaattgatatcgggatgttgaccactccccgggatcgctttgattttgccaaagacaaagaagcacatagggaatatttccagaccattcctgtaagtcgtatgattgttaataattatgcgcctctacacctaaaggaagttatgttaccaaccggagagttattgacagatatggatccaggaaatggtgggtggcatagtggtacaatgcgtcaaagaataggtaaagaattggtttcgcatggcattgataatgctaactatggtttaaatagtaccgcaggcttaggggagaatagtcatccatatgtagttgcgcaattagcggcacataatagccgcggtaattatgctaatggcatccaggttcatggtggctccggaggtgggggaattgttactttagattccacattggggaatgagttcagtcatgaagttggtcataattatggtcttggtcattatgtagatggtttcaagggttctgtacatcgtagtgcagaaaataacaactcaacttggggatgggatggtgataaaaaacggtttattcctaacttttatccgtctcaaacaaatgaaaagagttgtctgaataatcagtgtcaagaaccgtttgatggacacaaatttggttttgacgccatggcgggaggcagccctttctctgctgcaaaccgtttcacaatgtatactccgaattcatcggctatcatccagcgtttttttgaaaataaagctgtgttcgatagccgttcctccaccggcttcagcaagtggaatgcagatacgcaggaaatggaaccgtatgaacacaccattgaccgtgcggagcagattacggcttcagtcaatgagctaagtgaaagcaaaatggctgagctgatggcagagtacgctgtcgtcaaagtgcatatgtggaacggtaactggacaagaaacatctatatccctacagcctccgcagataatagaggcagtatcctgaccatcaaccatgaggccggttataatagttatctgtttataaatggtgacgaaaaggtcgtttcccaggggtataaaaagagctttgtttccgatggtcagttctggaaagaacgtgatgtggttgatactcgtgaagcgcgtaagccagagcagtttggtgttcctgtgacgactctggtggggtattacgatccggaaggcacgctgtcaagctacatctatcctgcgatgtatggtgcctatggcttcacttattccgatgatagtcagaatctatccgataacgactgccagctgcaggtggatacgaaagaagggcagttgcgattcagactggctaatcaccgggctaacaacactgtaatgaataagttccatattaacgtgccaacagaaagtcagcccacacaggccacattggtttgcaataacaagatactggataccaaatcgctcacacctgcgccagaaggacttacctatactgtaaatgggcaggcacttccagcaaaagaaaacgagggatgcatcgtgtccgtgaattcaggtaaacgttactgtttgccggttggtcaacggtcaggatatagccttcctgactggattgttgggcaggaagtctatgtcgacagcggggctaaagcgaaagtgctgctttctgactgggataacctgtcctataacaggattggtgagtttgtaggtaatgtgaacccagctgatatgaaaaaagttaaagcctggaacggacagtatttggacttcagtaaacctaggtcaatgagggttgtatataaataatcctgagacggtgcggccacttcggccgcattagtaacacattcgtcccgttaatcaaaacataaagtagcgtccagcgttttattatgttgttctttctatcattccggggtgaccggggcttatttataaaagatatcgtacttaaaatgctgacgccaaaccggctattgtgcgtaattttacttattgccggatatcagctggtgtcggttatccatcatttctggctgactcaggcagcatcggtgcccggcttatcccgtgttagcgcgccggaaacagcggtaactggtgatcaaactgaagaacgttttgtttttacgttattcggcagggcatccccactatcatcggaggggagagcgcaggaaacaatgccttccctgtcagatgatctgctttcaggggaggatcttgacgtgagaggtatactttatagttcggttgcagagcattccgttgccatatttgcacataataacagacagttcagtctgagcgtcggcgaaaaagtacccagctacgatgctacgattagtgctatttttagcgatcatattgttattaactatcagggaaaaactgtatcactgcctctgcgatatgataataccgaaaaaaagaatgcatatgacaataataatttaacagttggagacgtgataacccaagataattttcgggtagaaagtgtttttgatattatgagcttttcagccgttacggttaataatacattaagcggttatcgcttgattccgggtaagcacagttcgttattttataatgctgggttgcatgataacgatctggccgtatcggttaatggttcagaattgcgtgataccagacaggcgcagcagataatgaagcaattgccagaacttaaagaaataaaaataaccgtcgagcgtgatggtcagttatatgatgcatttattgctgtaggagaaaactgattgttcaggaaatggttgaatgggcgtttgccggtacttgtgttcactacagtaattttgggggccattccagggtggggggctgaattttcggccaactttaaagatacggatattcaggagttcataaatactgtcagtaaaaatttacacaaaacggtaataattaatcctgacgtgcagggaaccatcactgtacgcagctacgatatgctgaacgaggaacaatattatcagttctttctcagtgtgctggacgtttatggttttgctgtggtcgatatgcacaacggtatactgaaagtagtgcgctcaaaagatgccaaaacgtcggcggtgccggtagctagtgatgtcagtcccgggactggtgatgaggttgttacccgggtggtccccgtaagtaacgtggcagccagagatctggcgcctttgctgcgtcagctcaatgataatgctggcgcaggaagcgtggtgcattatgaaccttctaatgttttgttgatgaccggacgtgctgcagtgatgaaacggttgatggagattgttgaacgtgtggataaggtgggtaatcgcagcgttgccacggtcccgctcacctacgcgtccgcaacagacgtagccagacttgttacggaactgactaaagaaacagataagacagctatacctgcttggatgacggcgaaactggttgcagacgagaggacaaactcagtgctcgtcagcggagagccaatctcccaacagcgtatcatctccataattaagcaactggatcgtcaggaggatgttcagggtaatactaaggtgatttacctgaaatatgcgaaggcgaaggatttagtggaagtcctgacaggtatcagcagcagtattgaaaacgactctaaaaagagtccgtcaacggaagccttgcgcaaaggagtgacgattaaatcccacgaacaaaccaatgccctgatcctgacgggggcccctgacgtcatccgcgaccttgaaaatgtgatttcgcagttggatattcgtcgtcctcaggtcctggtggaggccatcattgctgaaatacaggatgctgacgggctgaaccttgggatccagtgggtgaataaacatgccggtgtggcgcagttcaccagtaccggtttacctattaccacgatggttcagactcgtcagaacgaaatcttagacagcgatcagagcaatgccctgagcatgtttaacggaattgcagcggggttttatcagggaaactgggcgatgctgttgacggcgctctccacaagtagcaagaatgatatcttggcgacccccagtattgtcacgctggacaatatggaggccactttcaatgttggtcaggaggtcccggtactttcgggctcacagacaacctctggggacaatatttttaacacggtcgagcgcaaaacggtggggatcaaactcagggtaaaaccccagatcaacgagggtgattccgtgttactggagatagaacaggaggtgtccggtgtggcggacactgcagtagccaccactactgacttgggagcaaccttcaacacccgaacagtgaccaatgccatgctggtcgggaatggcgaaacggtggtggtcggaggattactggataagtcgatcagggggagtgagagtaaagtgccactgctgggggatatcccggtactggggcatctttttcgcgcaaaaagcgaacagacagctaagcgtaatctgatgctgttcattcggccaactattattcgtgagcgcgacggatttcgtcatgcttcggccgaaaaataccagtcgtttaatcaggaacaggtgcagtcgcgtggcaaagaaacaacggcgctgacgctgaatgaggaacagctcaggctgtcccccgatcaagacgatacggctttccggaaggtgaaagcggcgattgctgcgttttatgcgcaggagatgtaatgagcagagtagtacagaatgtcagtgaatcacgtccccttctgcctttttccttttcccgtacgcagagaattttgttgctgcgtgaacaggaggggaatcgagtgttctgcatggaggacacacctgccagtgccctgttggaggtgcgcagggtggctgaaggtcctctgaatgtcacaacagtgtcggcggaagcgtttgaaaaacagctggtgagcagctatcaacgtgattctgatgaagcgcgacaaatgatggctgagattggtaatgaaatggatttttataccgtcgcaggggagttgcctgaccgtgaggacttactggatgcgaatgacgatgcgccaattatccgcctgattaacgcaatgctgacagaggcaattaaagagaaagcctcagatattcatattgaaacttacgaacgccatctgcaggttcgctttcgcattgatggcgttctgcgggagatcctccgtttacataggaatctggcttcgttactgatttcacgcattaaagtcatggcccggttggatattgccgaaaaacgcgttccccaagatggccgcatggtactgcgtatcggtggtcgggcggtggatgtgcgtgtttcaacgttgccttcaaatcatggtgaacgcatcgtgctgcgtttactagacaaaaatagcgttagtctcgatcttgctgcactcggcatgtcgcagcagaatcagcgacacattgatgcactgatccgccgtcctcacggcattattttggtgaccgggcctacagggtcgggtaaaagcacgacgctttatgccgcgttaagcctgctgaatccccgagaccgcaacattatgacggtcgaggatcctgttgaatatgaactggacggtatcagtcagacccaggtcaacccgaaggtggacatgacctttgcccggagtctgcgcgctattttacgtcaggatccggacgtggtgcttgtgggggagatccgtgacggtgaaacagcccagattgctgtgcaggcctcgctgacagggcatttggtgctgtcaacgttacatacgaatagtgcagcaggcgcgctgtcgcgtctgcaggatatgggcatccctccttttctgctttccacctcattactggctgttctggcccagcgactggttcgcacgttgtgtccgcgctgtcgtcagccctgtcaggtcagtactgagttagcgatggacatggacattccccctgaaaccacgatctggcagcctgccgggtgtcagcactgcagtttcacgggctatcacgggcgcaccgggatccacgagctgttgctgattgacgatcgcattcggacggcaatctatcagggggagggggagctgggtattacccgcttggcagggagtcgctatctgacgctgcgtggcgacgggcgacaaaaggtactagccggtgagaccagttgggaggaggtggttcgcgttactgaaagcagattgcaggaagaggaatgatatggcgttgtttcattatcaggcatcagatattcacggtagaaaacgcagtggcattctggaggcggattcggcccgacatgcccgtcagttgctgcgtgagcaggcgcttattccagtcaggttggatgagaaacaggtccatcacaagcactcactgcggagtatcctgaggtttcgtccgcgcggggggagcagcgccgaactcgcgttactgacacggcagttagccacactagtggccgcatctctgccgcttgaagaggcgctggatgcgttgttgaggcagagtgaaaaaccgcgtcagcggaacttaatcgctgccgtgcgcaccaaggttctcgagggacattccttggccgcggcgatgggcatgtttccaggtacgtttgagcgtctttattgtgcgatggtggcggcgggggaaacatccggtcgtttggacgtggtgctcagtcgtctggctgactataccgagcagcgccagatcatgcgaaaccgtctactccaggcattgctctatccttgtgttctgacgttggtggcggttggggttattgccattctgcttactgcggttgtgccgaaagtggttgagcagtttattcatatgaaacagacccttcccttatctacccgcgtactgatgggggctgctgaggtgagccagacttggggcccgtggctgttactggccgcagcgctgggcgggatagcggggcgcatgatattacatcagccctcccagcgtctggcttttcatcatctgctgttgcggctgccggtcgtggggcgcatatcgcgcggtctgaataccgcacgttatgcccgcacgctgagcattcttaatgccagtgcggtaccgctgctccaggcgatgcacatcagtggtgacgtactgagtaatgactgggcccgtcatcagttagctaccgcggccgagttggttagggaaggggtcagcctgcatcaggcactggagcagacttcgctgtttccgcctatgatgcggcacatgattgccagcggtgaaaatagtggcgaactcgacagcatgttggaacgggccgccgacaatcaggatcgtgagttcagcacacagatgcaactggcgctgggattgtttgaaccgctgttggtggtgggtatggccggggtcgttttgtttattgttctggcaattctgcagccgctcctgcagctcaacaacatgatgaatatgtgaatccttctttaacagtcaacggagaaaaacatgcgaaaacagcatcagcgtggttttaccttgctggaaataatggtggtaattgtgatcttgggagttttggccagtctggtggtcccgaatctgatgggaaataaggataaggccgatcggcagaaagtgatgagcgacttggttgcgctggaaagcacgctcgatatgtaccggttagataataaccggtatccgacaacggagcagggactgcgggcactggtcagtaaacccaccgtgcaacctgaaccccgtaactaccggcaggatggttatatccgccgtttgccccaagatccttgggggggggattatcagctgttaaatcctggtcagtacagcgacattgatatcttttctcctggcccggatggtgtgccaaacactgaagatgatattggtaactggacgctcggtaacgcgcagccatgagtcagcgcggtttcacaatactggagatgatgctgatccttttgttgatgggcatcactgcagggctggtactaatgtcatttcctgactctgctcagaatcatctgcaacaacagcgggagcgtctgcaggcgcagctggattatgccttggatagaagccagcaggacggcttgctgatggggattcaggttcggtttgacggatggaaatttaaggttctgcagcgcggaacagcggaaagccccccgacattagctgagggaggggatatttggcaggggtatgtctggcaaacttggcaaccgcgacgtgcagccatggggggcaaacttccggatgatgtgcgtcttgagctgcagtatctcagaggtttgcagtggatgtctgagcatgatgacggggctgaacccgatattttgctgcttcccggaggtgaggtaacgccgttcagacttcttttcaggcaggtcggagaggaggccgttgtcgggctgcaggttgatgagaacggtttgatgactctttttgaaggtgaggtctcattgtgaaggggcaagaaggaatgacattactggaagtcatagtagctctggttgtgtttgcgctggcaggaatggcgctgatgcaggcctcgacccagcaggctgcggggatcggacggatggaagagaaggtgctggcaggctggttggccgataaccagatggtgcaattgcaactcgagaaaacttggccggaaaatggctggggcgagaagacgatcagcttcgctggcaccgaatggtatttacgctggggcgggccggacagcgacgtgccgcagccgcgctccttagaggtagaggtacggcgcactaaagaggagacgtccgccttggtttccttgcgtagcagtgtggttcgtgaatgagtcagcaacgggtaaaaggttttacgctactggaaatgctgttggcactggctgtttttgcagcgttgagcatcagcgcatttcaggtgctgcagggtggaatacgggcgcacgagctgtcccgggataaagtacagcgtctggctgagctgcagagagggatcagccagatggagcgagatcttacgcagatgctcccaaggcacagccgggggaatgaaggcctgctgctcgctgcacctcatctgctaaaaagtgatgactgggggatttcttttacgcgaaacagctggctgaatcccgccgggatgctgccgcgcccggagttacagtgggtaggttatcggttgcgacagcaaaagttagaacgcctgagctactttcatgtcgatcacccttccggtgtttctccggatgtcagggtgatgctggacggcgttcacgcatttcgtctgcgtttttttgttaacggtgattggcaggcgcgctgggacagtaccggcatcctgccgcaggctgttgaagtgacgctggttatggatgattttgctgaactgccccgtctgtttcttgtgagcaaggagaccgctgaatgaaattgcgggaacagggcgtggcgcttctggtggtattgctgatcctgtcgttaatggtaacgatagcggcggtgattgcggagcgcaacggtcggacatttttgcgtacagtagcgcagttggatcagctgcaggcaaagtgggatggctatacggcagagacgatagcaaaacaaatcttacagaggagcaggcaggagtcgccccggaaaacgcatctggcacaaaattgggcgcagtcagaacgacagtttgagaccagagggggagatgtgcgggggcagatcgtggatgcgcaggcctgttttaatcttaatgctattaattatggagtggtggatctgaccagtataccttatgccgccagaatttttcagcagctattaatcaacttgcaggtagagcttttacaggcccggcaagtgacggcagccctacgtgactggatcgatcgtgatgataagccggtaaggggcggtgctgaagacgaggtgtatatggggatggaacctccctatctggcagccaaccagccgatgcaggacgtcagtgagttacgccttatccggggaatagatgccaggctttaccgcaaacttttgccgtatgtttgtgtactgcctacgtcagatctgtctgtgaatgtgaatactctgctggattcacaggcgccgctgctggcggcgctctttctgacgaaaccggacagtcttccggtgacggaattactgcagcggcgaccccgtactggttgggagagcgtggcggcgtttcttgacgcgccaccgcttaaggacattgacaccagtgcggccatgccggtattggccgtcagcagcaactattttctggttcggttacatgtgcgctccggggaacacctgttcagtcagcagactttaatgcagtggagggaggagcgtttccggatcattcagcgacagtatggattaacgatgagggaggttccctgaaaaaaaataacaaacatgtcgaggctggtcggctttttctgcgactgccggaggatgactcggagcctttattgtggaggctgattgcgccagaggagacaggagccggcagtgtggcagtcggagaaacggatccgcagttagtcggtttgctgtcccgttatcccgcctgggtgctggttccgtcaggcagaattgccttccatcaggtcacgctgccacaccgcacgtggcgtcagcgtttgcaggtgctgccctttcttctggaagagcagttggcgacagacattgagcagctgcacttcgccattcttcatcagtcgggtgacaggtgtgatgtggcggtggtcgaaaaagcggttatgcatcgctggttagcgtactgtggacaacttggggttcgggaggtgaggttgctgcctgacgtactgatgctgccgttggcaactgaaggatggagtgccgtaaagcttgccgggcagtggctgtttcgccgggatcgttacgccgggatgacggtagagttatcgtggctgacacatttcttgtctcttactgcgccgccggtgattgagtcctactccgtgccgccagtaccgtgcccgggtccgaagaccactgagtggcgaaatcagcccggacgcgatctgctgcagttggtggccgaaggtgacgggtatgatggcgcagatctgcggcagggagaatttgcccgccagggaacatggtatgcacgatttcgcccatggaggtatgtcgcaggggctctgctggcctgtgtttttctggccgggagcaacgcggggctggcacattatcggctctggcagcaggctcaattctggcggtatgagagcgtacgtgtctatcagcagctgtttccgagtgaaaaggcggtgaaggatccccgccggcagatgctgagacatctgcaacagtcgacgggtaacaatataccggaactcgggagcgtgatgcgccagcttcagcaactgctgtcagaaacctcaacgatacgcttacaggcactcgcctgggacagcagcagccagacactgaaaattgatttgcaggcggcttcttttcaggcgctggaacactttcagcagatcgccggagaaaaatacctcatccagcctggtgagatacgacagcagccgcagggggtagaaagtcgtctgatcctgagagtgaacaatgaacgagcttaaaaaacgtttgcagtatgttagcccccgtgagcgcaggctgcttatcggatgtgttgccttactggttgttgtttttgtctattacgtcctctggcagccctggctgatacgagaggataagtggcggactgtagttacccgtgaaaaaaacacagtggagtggatgaaacaacaggtacccaacataaagagacgggaggcaagtatgcctgaacagggggagccgttaggtttatctgcggccgtgacacgtacttcagccgcatacggtgtatcggtcacccggttgcagcctcaaggggagcgtctggccgtcaccttagccccggttgaatttaatgcgctgatgcagtggcttacgcaactggagcgtcggcaccgtattcgtaccatggtatttgatgtggccgcgcagggcaacccacccggacaggtaacggttaatcggctggttttgtcccaagatgacgtaaacaaggacgcttcgcttagtcgctgatgtcgtaatttacagattaatgcttgatgtaaaaattggacttataaaggaggatgtgtgagtagtttgccggaatttgcggttgattatcccttgttgtggctcatctgcaccggagggctggggggcgttaccggcagttttcttaacgtcgtgattcatcgtctgccgataatgttggagaggcggtggcggcgtgaagcgctgacgctattggcacattctgtgcctgagtccgggccggcctttaacctgatgataccgcagtctcattgtccctgctgttttcatccgctcggcatcagggataacattcccctgttaagctacctatttctgaaggggaaatcacgctgttgtggcgagcgtattcccgtttactacccgctagtcgaaataacgaactcagtgttattcattctggccgcgagcaggtttccaccagggctgacattagcggctgcctggctttttatttccatgctgttggttctggcggttattgactgccatacggcgctgctgccggatgtgctgacgttgccattgctctggcttggcctgttattcagtttacagagaggcgttgtcaccttagaggaggcggtagtgggggcggtatctgggtatctctgtctgtggggactgtactggctttttcgtttcgctaccgggagggaagggttaggttacggtgattttaagctagctgcggcattgggagcatggatgggttggcaggcattaccctcaatacttttgtttgcctcagtcagtgggttaatcgtaacagtactgttgcgtattgtaacagctacggactttacccgcccgctgccttttgggccgtggctcgctttgagcggagtgtgccattttttgttgatgtagcgttcggttaccggggctagtaataaaaacggctcagcggataaaagaactgttgtaaaccggtatcaggttaaacgatacctagtaaaaaatgatgggtaatattttgaaaaaactgaattgtatcgcgtcattactagtcttagtgactatctctggttgtcatcagtcaccctccatccataagcaggccactgttcctccgagcgaacaactggaacaaatggcgtcgattgtctctgcgacacggtatctgaaaatgagatgtaaccgtagtgatttaccagatgaacagtcgatcctaaatgtcgctaaccggatcgctatcgggaaagggtggcagtcattaactcaggaggatatacgtaaacacagcgatgatatctatgtgcgtctgactagggacagtacgcctgagtatataaaatgcagagaattcaatcggcggctggtcccatttatcggtgaattattggcaaggggtcgtggataatatgaaccgccccggaaatcctggagactaaactccctgagaaagaggtaaacagcatgaataaaaatgggtcttcccttgtagtggtggctgaaggcatgatgattgtagtggcacactgaatttggccacctgaacagaggtgatatgctcacctcagaacaacacaggtgctccaatgaaaaaaagaaatttcagcgcagagtttaaacgcgaatccgctcaactggttgttgaccagaactacacggtggcagatgccgccaaagctatggatatcggcctttccacaatgacaagatgggtcaaacaactgcgtgatgagcgtcagggcaaaacaccaaaagcctctccgataacaccagaacaaatcgaaatacgtgagctgaggaaaaagctacaacgcattgaaatggagaatgaaatattaaaaaaggctacaaccgcgctcttgatgtcagactccctgaacagttctcgataatcgggaaactcagagcgcattatcctgtggtcacactctgccatgtgttcggggttcatcgcagcagctacagatactggaaaaaccgtcctgaaaaaccagacggcagacgggttgtattacgcagtcaggtacttgagttgcataacatcagccatggttctgccggggcaagaagcatcgccacaatggcaaccctgagaggcttcagaatggggcgctggcttgccggcaggctcatgaaagaactgggactggtcagttgccagcagcctgcgcaccgttataaacgaggtggtcgtgaacatgtcactatcccgaatcaccttgggcggcagttcgcagtgacagagccaaatcaggtatggtgcggcgacgtgacgtacatctggacggggaaacgttgggcataccttgccgttgttctcgacctgtttgcaaggaaaccggtaggttgggcaatgtcgttctctccggacagcagactgaccatcaaagcgctgaaaatggcctgggaaatccgcagtaaaccagccggggtaatgttccacagcgatcagggcagccactatacaagcaggcagttccggcagttactgtggcgttaccagatcaaacagagtctgagtcgacgaggaaattgctgggataacagcccgatggagcgcttcttcaggagtctgaaaaacgagtggataccggtgacgggttacatgaacttcagcgatgctgcccatgaaataacggactatatcgttgggtattacaacgcgctcaggccgcacgaatataacggtgggttgccaccaaatgaatcggaaaaccgatactggaaaaactctaaagcggtggccagtttttgttgaccactacatcccgtcagccgatttacgggccgtaagtaacgaagttggatgcaaatgtcagatcgtgtgcgcctgttatggctcggctggtaagagagccttataggcgcatttgaaaaaactccagctataccggaagagatttattattaacaggagaggtttgcttttctgtgtaggtttagattttgtgtttgcagggtaaacaaaactgattaactcgtcatttcggtaactgaaatagtttgctgtattctgtttacaatctctttaataaggcatttgtcacgtggctattcatatgaaaatcatacgttatcttacaaatcaatcatctgagtgttataatataacttagctgtgatatgtgtaagaatgtttaggcaatatattattatcgctaatgttgttttggttgggagagattctccttgcggtagctttctgtttttagatgcttcttgcttaaaaggatataatttctgttcttttatatagggttctttacatttactgagttttcttatttatttaaacattatgaaatctaatgcttttgacgtcatggggaaggttgcatggctatgggcctgttctcctctgcataaaaaatggccattatctgtttttgctattaatgtcatacctgctattcagacaaatcaatttgctctcttaataaaggatgagcttcctgtagctttttgtagctgggccagtttagatctggaatgtgaggtaaaatatataaatgatgtaacatctttgtatgcaaaagactggatgtcgggagaaagaaagtggtttattgactggatagctccatttggacacaacatggagttatataaatacatgaggaaaaagtatccttatgagttattcagagcaataaggttagatgagagcagtaaaacaggaaaaatagctgaatttcatggaggggggatagataaaaaactggcatcaaaaatattcaggcaataccatcatgaacttatgtctgaagtaaaaaacagacaagattttaattttaatattgagaaagaaaactaatatgacagtaaataaaataaagaacattttcaataatgcgacattgactacaaaatcagcatttaatacagcatcatcaagcgtacgttccgctggaaaaaaactcatattattaatacctgataattatgaagctcagggcgtgggtattaatgagttggtcaaagctgctgatgagcttggaatagaaatacaccgtactgaacgagatgatacagcgattgcaaaccagttttttggtgcagcagaaaaagttgtaggattaactgaacgtggtgttgcaatattcgcaccacaacttgacaaacttctgcagaagtatcagaaagttgggagtaaaataggaggaaccgctgaaaatgtaggtaataatctgggaaaagccggaacagttctctcagcactacagaattttacggggattgctttatcaggcatggctcttgatgaattgctgagaaaacaacgggaaggagaggatataagtcagaatgatattgccaaaagtagtattgaacttattaatcagcttgtagatacagtatcaagtataaacagtaccgttgattcattttctgagcagcttaaccagcttggctcatttttatccagtaaacctcgattaagttctgttggtgggaaattacaaaatttaccagacctgggccccctgggggatgggctggatgttgtctccggaattctttctgctgtatcagcaagctttattctgggaaacagtgacgcacatacaggaacaaaagctgcagcgggtatcgaactgacaactcaggttcttggaaatgttggtaaagctgtttcgcaatatattctggctcagagaatggcacaggggttatcgacaacagctgcaagtgcgggtctgatcacatcggctgttatgctggctatcagtcctctttctttcctggctgctgcagataaatttgagcgagctaagcagcttgaatcatattctgaacgatttaaaaaattgaattatgaaggggatgctttactcgcagcctttcataaagaaaccggagctatagatgcagccctgacaacaataaatactgtcctgagttctgtatctgcgggagttagtgcagcctccagtgcatccctcataggggccccgataagcatgctggtgagtgcattaaccggtacgatatctggcattctggaagcatcaaaacaggctatgtttgagcacgttgcagagaaattcgctgctcggatcaatgaatgggaaaaggagcatggcaaaaattattttgagaatggatatgacgcaagacatgctgcgtttttagaagactctctgtctttgcttgctgatttttctcgtcagcatgcagtagaaagagcagtcgcaataacccagcaacattgggatgagaagatcggtgaacttgcaggcataacccgtaatgctgatcgcagtcagagtggtaaggcatatattaattatctggaaaatggagggcttttagaggctcaaccgaaggagtttacacaacaagtgtttgatcctcaaaaagggaccatagacctttcaacaggtaatgtatcaagtgttttgacatttataacaccaacatttaccccaggagaagaagttagagaaagaaaacagagtggtaaatatgaatatatgacatctcttattgtaaatggtaaggatacatggtctgtaaaaggcataaaaaatcataaaggtgtatatgattattcaaaattgattcagtttgttgaaaagaataacaaacactatcaggcgagaataatttctgagctcggagataaagacgatgtggtttattctggagcaggctcatcagaagtatttgctggtgaaggttatgataccgtatcttataataagacggatgttggtaaactaacaattgatgcaacaggagcatcaaaacctggtgagtatatagtttcaaaaaatatgtatggtgacgtgaaggtattgcaggaagtcgttaaggaacaggaggtgtcagtagggaagcgaacagagaaaatacaatatcgtgattttgaattcagaaccggtggaattccttatgatgtaatagataatcttcattctgttgaagagctcattggcggaaaacatgatgatgaattcaaaggcggtaagtttaatgatatattccatggcgcagatgggaacgattatatcgaaggtaattatggtaatgatcgactatacggcgatgatggggatgattatatatccggaggacagggagacgaccagttatttggtggtagtggaaacgataaattgagtggaggggatggtaataattatctgacaggaggaagcggtaatgatgagcttcaggcacacggagcttataatattctgtcaggtggtactggtgatgataaactttatggtggtggtggtattgatcttctggatggaggggaaggtaatgactatctgaatggtggttttggtaatgatatttatgtttatgggcaaaactatggtcatcatacaattgcagatgaaggaggtaaaggagatcgtttgcacttatctgatattagctttgatgatatcgcatttaagagagttggaaatgatcttatcatgaataaagccattaatggtgtactttcatttaatgagtcaaatgatgtcaatgggataacatttaaaaactggtttgcgaaagatgcctcaggagcagataatcatcttgttgaggttataacagataaagatggtcgagagataaaagttgataagatacctcataataataatgaacggtcaggttatataaaagccagtaatatagcatctgaaaaaaacatggttaatatcaccagtgttgccaatgatattaataagattatttcttcagtttcagggttcgattcaggtgatgaacgattagcatctttatataatttatccttacatcaaaacaacacacactcaacaactttaacgacaactgtctgagactaaaagaggaggtgatggccattccaggaggaatggtcatcgttatatgatgagtaaatgtagttctcataatagtctgtatgcactgatattgcttgcacaatatcataatataactgtcaatgctgaaactataaggcatcagtataatacccacacacaagattttggggtgactgaatggttactggcagcgaaatctattggcttaaaagcaaaatatgtagaaaaacatttttccagattgtcaataatttctttacctgcgttgatatggcgggatgacggtaagcattatatattgtctcgtattactaaagattcatcacgctatcttgtttatgatccagaacaacatcagtcactaacttttagtcgggatgagtttgaaaaactgtatcagggaaaagtcattctggttacgtcaagagcaacagtagtcggagagttagctaaatttgatttttcttggtttatcccctctgttgtgaaatacaggaggattttacttgaggtgttaactgtttctgcttttattcagtttcttgcgttaataacacctcttttttttcaggttgtaatggataaggttttagttcaccgggggttttcaacgttaaatattatcacaatagcatttattatagtgatactttttgaagtgatattaaccggagccagaacttatattttctctcatactacaagtcgtattgacgtcgaactgggtgctaagttattcagacatttgcttgcattgcctgtttcatattttgaaaatcgcagggtcggagagaccgttgccagagtaagggaactggagcaaattcgtaattttttaaccggacaagcgttgacatcagttcttgatctatttttttctgtaatatttttttgtgtcatgtggtattacagccctcaattaacactggttatattattgtcactaccttgttatgttatatggtcattgtttatatcacccttattacgtcgacgtcttgatgataagtttctcaggaatgcagaaaatcaagcttttcttgtcgaaacggtaacagcaataaatacaatcaaatccatggcagtatcaccacagatgattgctacatgggataaacaactggccgggtatgttgcttccagtttcagggtaaatctggttgcaatgacagggcagcaggggatacagctgatacagaaaagtgtaatggtaattagtctatggatgggagcacatcttgtcatatcgggagagataagcatcgggcagttaatcgcgtttaatatgcttgcaggtcaggtcattgctcctgttatcagactggctcatctttggcaggattttcagcaggttggtatttctgttgagcgccttggtgatgtattaaatacaccggtagagaaaaagtcaggcagaaatatactgccggaaattcagggggatatcgaatttaaaaatgtcagatttcggtattcttctgacggtaatgttattttgaataatattaatttatacatatcaaagggggatgttatcggtatagttggccgttctggttcaggaaaaagtacattaacaaaactgcttcagcgcttttatataccagagaccggacagattttaattgatgggcatgatttatcacttgcagatccagaatggttacgacgccagattggtgttgtattgcaggaaaatatactattaaatcgtagtattatcgataatattacattagcttctccggctgtatctatggaacaggctattgaggcagccagacttgcaggtgcccatgattttattagagaactaaaagaagggtacaatactattgttggagaacagggcgttggtctttcaggagggcagcgccaacggatcgcaatagcccgggctcttgttacaaatcctcgaattcttatttttgatgaagcaaccagtgctcttgattatgagtcggaaaatataataatgaaaaatatgtcaagaatatgtaagaacagaaccgtaattattattgcacacaggttgtcaactgtaaaaaatgcaaacagaataattgttatggataatggctttatttctgaagatggcacacataaagagcttatctccaaaaaagacagtttatatgcatatttatatcagttgcaggcataacgtatgcgcttttacatgaaaggtttatgggatttggtttgccgttataagacggttttttctgatgtctggaaaattcgtcacacacttgatgctcctgtgagagaaaaagatgagtatgcatttcttcctgctcaccttgaactcattgaaacaccagtatccagacgttctcattttgttgtatggagtattttattatttgtaattatatctcttctcttatctgttcttgggaaagttgaagtggtttcagtagcaaatggtaagtttactcatagtggaagaagcaaagaaataaaaccgatagagaatgcgattgtagaaaaaataatggtaaaagatggctcttttgtaaaaaaaaatgatccattagttgaattgacggtgcctggtgttgaatctgatattttaaaatcagaagcatctttgttgtatgaaaaaacagaacaatatcgctacgcaattctttctgaatcaatacaacggaatgagcttcctgaaataaggataacagattttcctggcggagaagataatgcgggaggtgaacattttcagagggttagctcattaataaaagagcaattcatgacatggcagaacagaaaaaatcaaaagcagctcacattaaataaaaaaatagttgaacgggatgcagcgcttgctcgtgttagcctgtatgagcatcaggtatcacaggaaggaagaaaactcaatgattttaagtatttgttgaataaaaaagctgtttctcaacattcagttatggagcaggaaaatagctatattcaggcaaaaaatgaacatgcagtctggcttgcacaggtttctcaacttgaaaaagaaatagaacttgtgcgggaagaactggcactggagacgaatatcttcagaagtgaaattatcgagaagcacagaaaatcaacagataacattgtgttgctggagcatgagcttgaaaaaaacaggcagagaaaagcatcatcttttattaaagctcctgtgagtggtactgttcaggagttaaatatacatacagaaggtggtgttgtcacaacagcagaaacgctgatgattattgtccctgataatgatattctcgaagtaacagcatctgtacttaacaaggatatcggttttatacaacctggacaggaggtcgttattaaagtagatgcatatccatatacacgtcatggttaccttacagggaaagtaaaaaatataactgcagattctgtttctgttccggatacagggcttgtatttaacgtgattatatctgttgatcggaatgatatacagggagaaagaaaaaaaatccctgttacagctggaatgactgttatggcagaaataaaaaccggggtgcgtagtgttatcagctatcttcttagtccattaaaggaaactattaatgaaagtttacgtgaacgttagtatataaataacatattggctttttatatgatatagatttctgaaataatcttgtaaagattatctatgttatttaaacaaactatgatacagtttttatctttaaaaatagttaatggaatggatagtattaaattacttgataaagttattatctatcaacaacagaatgagcaattatatccagcacaggaacatcttcttttacaactttgtatgcgagttaccaaaaaacttactgatatattaatgcctccctgaagggggatggtataaacgatacaacgcttatgcttctagccttgttatccagtactgataatttctgcttatcttcgactgaactcagtgaaagattagatgtttccagaacatatatcaccagagcttgtgattctctggaaaaatttggttttattaaacgtatggaaagtaaggaagatcgacgtagtaagaatatttatctgacttcagacggtaatttgtatttacagcggaccacaaggatatatggacgctatttaaaaaaatatggagcaaccttacagatgatgaaatcaaaacatttaaaataatcagcaaaaaggttttatctcaaaatatttctcagtaatattacatgtaatcatgtatataaatcctgagttcttatttttataatttattattctgcaattgtgtaggggggatagatactggttattccccctcttttttctggtaaggaaaatcagagttacgctatgtggattttgaacgtatttcaggtgcataaatctgtcagaatctacatagcgcatttttcagttttcaattgtcacttacatccatccattgatagatcattagcgtcctggcattaccccaattctcccaaaaacggcaaaccagccctcagcccgcgccacgactggcttaatacgggatccctgctgcaaaacgtacctttacgtatttggttttacccgcaataatgcgtgataagcaaacaaaaggatccgcacgctgcgatttattgtcgtggaaggatccgggcgttcaggtcagaatacctgtatccataaacagtgcgtgtgctacgtgaaaaataactcatgaacaatgtcattcccctgcagaattcaccagaacgcgtcttcctgttacccattgcgccgggggtggattttgcaacagcgctctccctgagaagaatggccacttccacaggggccacaccggcctacctgctggccccggaagtgagtgcccttcttttctatatgccggatcagcgtcaccatatgctgttcgccaccctctggaataccggaatgcgtattggcgaagcccggatgctgacgccggaatcatttgacctggatggagcaaggccgtttgtgcggatcctgtccgaaaaagtgcgtgcgcgacgcggacgcccgccaaaagatgaagtccgcctggttccgctgacggatataagctatgtcaggcagatggaaagctggatgatcaccacccggccccgtcgtcgtgaaccattatgggccgtgaccgacgaaaccatgcgcaactggctgaagcaggctgtcagacgggccgaagctgacggagtacacttttcgattccggtcacaccacacaccttccggcacagctatatcatgcatatgctctatcaccgccagccccggaaagtcatccaggccctggcaggtcacagggatccacgttcgatggaggtttataccagagtgtttgcgctggatatggctgccacgctggcagtgcctttcacaggtgacgggcgggatgctgcggagatcctgcgtacactgcctcccctgaggtgacggcatacgcgcttccttatataagctgtggtcagcagaacagacataacataagctggagcatgtatataagctgtagtgagtaagtcatgttttatgaagggagcaatgcctcagcatcaggttacggggtgactcacgtaagggaccggcagatgacagctcagctacaggcagcactgcaggaaactgaatataaactgcagtgagcagaccactcactgcacctgataatataagctgtagtcagtaaaggaacactcttcactgactacagtttatgttcagcgggatttgaagagtttttccaggtcatccagcgtgatgcccagtttctcaagcagggcaagcttctccgccatctccggactgactttttccgcaggtgaaggtggcaacggattttccttactctcatcattcggtgcttttaaccggggacgccggtagtgaatgcagaagagttttgtccgcccccgctggatctccgtgtaatcaagatatccaatctcgcgcagctgctccattgcccgtctgaccgtctggttctgggaaaatacaggagacttcagattgaggcgtgcacgcagccgcgccagcgataccggtgccggatcccggggcaggctctctataaaggtgtagagtgcctgggcggactcccgtcgcttcagggcattaatcgccttaagctggagaaggacctttctgtcaaactggtacagttcaaaaaggcggggatcagcctgtaactgaacaatatcccgttcagtatcgtagtaggctgactgtaccagatgggtgatgtattcccgggtgtgcttctcatcggtgcgggaaaaggagatcacggtaccggcaatgcgtttcagggaagggctgatgcgctcacgcagcctgcgtgatgactggcttgaaggtataccacacagttttgcaaactcgacaaaaggcagttcaactttgtcaccaattacgttatggcgggcaaaggaatgaatgatccccacccaggtcttgaaatcgttatccatatccaggcgggggccggtgatctcaaccttatcgaatccctcagcacgggccagggaaagacgtgtcagctcttccgtggcatcagtacgtgacagtgtattttttttactgttcttcagtgatttaagggtcggtacaaaaacgcccagacgcatcagcgccacaggttgtacggtgttgttattgtttggtgtcagtgtcaccagctcaccggacgacttatccacctcgccgaacagttttttgatgtctgaattttcgttttccagaaagcctcctgcctgtggacagtaaaagaataaacagcaaatcgtgtgtcagagccccgctaactgactgaagaaaaacctgcagcctgtatttaacagctgagtctggcgtactgaccatagtttatgtcattaacttacttcagtatatggattactgaatacagcttatcattagcatgttacagtttatcagtaacatgccactgcttatgtgatcgtggtcccggcccatgagtgacaaggtttgcagcggtatggggatctttaatggatcctttgttgatcattcatggatctgtttactggatcgagcctccggatatgtggataaatcattccagggaaacagcatacacaaccgcttataagggtgcctgttcgatgaacttaagggttttcgggttaaagtcgtccctcaggtactgcagggcattctcaaggcagttcatgccgtgagtcagctcattactgtcattgagaaaggaaaagtgcgtcgcccacagtgagcctgattcgatgatgcccttcaggccgttcaggtcagtgtaatgataaatcttcatctggcagcctcctgactgtccgggccctgttcgcactcagttttttgcacgtcagacagaaacgggaacaccgtaatagcggcttcccttgcttcttctatcgaccgttcccgggcctgccattccggatctgctgccagcacttcgtcggcggtatcgcgtaaccaggcatacagctcttcgccaccatcgagatcaatctggcgggtttttaccgggtcctcatgcttcatgatattacgcaacagcttaccaatctgcccgtcagattcgacaggttcgtaaggaatgtagtccggatattcgtcgaattgatccagcgtcaaatcgatgtactctccgtccagcaatacgatgacatgcccgtgaactgttgagttttccgcttcatgaaagccagcgttcccttccataaaaatgatgcacggatggcatctctctcgttctttgaggtagtacgccagagtattgctggctaaatcgcagctgctgtgcgggaaattcctcagttccgttttccagcggggaaaatgacgacacccgtcagcccgttcaccgccaccaagctccagtgcccgtcgaaatgcctttatacgtaatactctttcctgtctcatttcttcaccttcccgtcctggcgggccagagccagcagttcggtctgaagctggcggccgtcctcccgggcttccttcagctccgccttcgtgtcctgcagctgcgccgccaggtgttcgccggtggcggtcaggcgggccacctgctcgcgcagcggcagcgcctccgcgcgtagctcgcgtacctcctgcagcaggcggtcacgttcggccaccacctcgcgcagcaccgccagctcgctttccagcgcggccacgttcgccagcgcctcatcccgctccttgtcggcccgggcaatgtcgtcgtcggcctgctcgcgcgccgccagggccccggcttcagcctgtttcacggccgcctgccacagcagccccagctggccggtcagcagctgcgccagctccggcggcaggggcgtggcctgctcgcgctggcgggcgcggaacgcgcgcatcaccggggagatgtgggacagggagccgccgccgaggtgctgacggacctgctcgttggtcgggttcggggtgccggcggcgatcagggcggcggcggcgtcttcaatgcggcggacggtgtccggggagagggatgtcatggtctggctccggtttctcagggaatggcgccatcgtatgcccggtatgaaaaatacacaatacatacaatacaattcatacatacagtacagaacttacatacactctttctcttttcctggtcagatccggtttctggtggttacggatcttcctctccctccgcacagcgttacatcccgtcagcacagcatgcagtgcctcattcagttgcccatggcactatatgttgtgttgtatctctggactgtgatgcgccgcgcaggggcggaaaacagcgatatgatgattttctcaggtggtacacttccggaaagtcgtttattcaaataaagtcggatccatacgaaacgggaatgcggtaattacgctttgtttttataaggcagattttaatttttattggttaacataacgaaaggtaaaatacataaggcttactaaaagccagataatagtatgcgtatttgcgcgctgatttttgcggcataagaatatatactgatatgtatacccgaagtatgtcaaaaagaggtgtgctatgaagcagcgtattacagtgacagttgacagcgacagctatcagttgctcaaggcatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctccgttatacacagccagtctgcagtcatggtaccggcagtgtattctgccggacagcctgcatcgctgcctgttgccattgattatccggcagctctggcacttcgccagatgtcgatggtccatgatgaactgccaaaatatctgctggctccggaagtgagtgccctgctccattacgtcccgaatctgcaccgcaagatgctgctggccacactgtggaacaccggagcacgcattaatgaagcactggcgctgacgcggggggatttttcgcttgcgcctccgtatccgtttgtgcagcttgcgaccctgaaacaacggaccgaaaaagctgccaggacggcggggagaatgcccgccggtcagcagactcaccggctggttccgctctctgactcctggtacgtcagccagctgcagacgatggtggcaacactgaaaatacccatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgctggtataccgctgaaagttctgcaaagcctgatgggacataagtccatcagttcaaaggaagtctacacgaaggtttttgcgctggatgtggctgcccggcaccgggtgcagtttgcgatgccggagtctgatgcggttgcgatgctgaaacaattatcctgagaataaatgctttggcctttatatggaaatgtggaactgagtggatatgctgtttttgtctgttaaacagagaagctggctgttatccactgagaagcgaacgagacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtttggtctgtccttttacagccagtagtgctcgccgcagtcgagcgacagggcgaagccctcgagtgagcgaggaagcaccagggaacagcacttatatattctgcttacacacgatgcctgaaaaaacttcccttggggttatccacttatccacggggatatttttataattatttttttatagtttttagatcttcttttttagagcgccttgtagcctttatccatgctggttctagagaaggtgttgtgacaaattgccctcagaagaagctgttttttcacaaagttatccctgcttattgactcttttttatttagtgtgacaatctaaaaaattgtcactgaaccgccccggttttcctggagagtgttttatctgtgaactcaggctgccagatcatcgtttccgatggaagcataataagctttttctgcttctgccggaggagtatggcccagccttcccagcaatcgtcgattgttataccagtccacccacgttagtgtggccagttccacttctgcacggtttttccagctcttacggtgtattacctccgctttgtaaagaccattgatgctctcagccatcgcgttgtcatacgagtcgcctgtactccctgttgatgccagtaatccggcttcttttagtcgctccgtataggccagtgacacatactgagagcctttatcgctgtgatggatggtgccagacggacgacgggcccacaacgcctgctccagcgcatccagcacgaatgtcgtttccatagacgatgagacccgccaccccacgatgtatccggcaaacacatcaatgataaacgccacatagacgaagccctgccatgtgctgacgtaagtaaaatcagccacccacagctggtcaggtcgttctgccacgaactgacggtttacgcggtcgcctgcggcaacggctttccggctgatggtcgtacggacctttttaccccggagaacaccggcaagtcccataaccgccatgagacgtgccactgtacatctggccaccctgattccttcccgtaacaactgacgccagactttacgcacaccgtacacctgatgattttcatcgtatacgcgctgtatctctctcttcagccagtcgtcgtgctgcgcacgggcactgcgtttatccggatgatgtcgctgttgctgacaatggtaatacgttgacggggcaatatgcagttcgctgcataccggtccgaccccgtactgctcacgcagcttatccagcagtggcatcattttttccagaggcggtcgaactccgccttcgcaaaataagcggaagcctggcgaaggatatcgttactgcggcgcagttcacgattttcacgttccagctctttcagacgctgacgttcagcgctggtgagcccaccatcaccgcccccggtatcccgctcatgctggcgaacccagacacgcagagtctccggcgtacagccaatctttggggcaatggaacaaattgccgcccactgtgagtcatattcatcctgactttccagaaccatacgaatcgcccgctgacggacttcgggggaaaaacgagtatttttagtcatcctgtttacctctttctcagggagtttagtctccaggaaacccggggcggttcacagtaccgtaagccggatggctcaggcatcgtctctctgaaaattgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaatgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccactcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacacagccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtgttgtcggtctgattatcggtctgggaccacggtcccactcgtgttgtcggtctgattatcggtctgggaccacggtcccacttgtattgtcgatcagactatcagcgtgagactacgattctatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgccggcctcctcacccggtcacgtttcgtcgttcctcctccacgcgctgcggcttcggggccgcacctgcattcgtatgcggtcgcccggttacaggtgcggcacggcctgatggaggccgcatgtgagaggagaattcccatgccaaactggtgctcgaatgtgcgacatgaagtcgcctgaataattgttccagcggagttcgattccgtcagggaacctgatgttccgtcatcagtagcctactgacacatgcgtcactggtaacggtggggtgtgaagctgtcaggacaatgaaaccggatcttcggatcgcatgaaaccgtgaggttacatgtaatctgccagcatcaggcggaggaggtctaggctcggtagcatgactaacatatgtgaactgctgaagcgtcgttaaccagaacaagccaaagatgctgacaggcttgaaccaaaaggtatgtggttggttactcctctgtttgctaggggtacacggacaataaaccaccggtgttgtgagcagagtctaacctactgttgttattcaggtggaacatggtaagcccgtatcgctgcctcgtgaggcaggttaaccgcaagggatactgttggcggtgcgggtaaaagaaggtggaaaaagcgaatgccagtctgtaatggaccggataagggttgagcccggcaacattaccctacgcgaaagcgggcagacttccactgggtctttcattacgagagagtttgagtaatcttccagaaaggaaaagcagatgactgagcaggctacaacctgtaaaggtgcgtccttacttaacggtgactcctggcacagtatcaactggcgtcagtgctatcgggaagtgcggagactgcaagcgcgtatcgtaaaggcaacacgagaaggtaaacatggcaaggtcaaatccttgcaatggatactgactcactcgtttagtggcagagcagttgctgtcagacgagttacagagaatagcgggaaacgtactcctggggttgatggtcagacatggtcttccccggaggttaaatttcttgctattaacctgctgaaacggcgtggttacaaaccacagccacttaagcgggtttatatacctaagtcaaatgggaagtctcgtccccttgggatacccactatgaaggatcgggcgatgcaggcgttgtatttgctggctcttgagcccgttgctgaagtcactgctgaccagagatccttcggctttcggactggaaggtctactgcagatgcgatagcacagtgcttctgtgttcttgcgcagaaaacatccgctgaatgggtgcttgagggggatatacggggatgctttgacaatatatctcatcaatggctaatcgataacacctcaacagacagacaaatcctgacaaagtggcttaaagcgggttacagggaaaaggggcagttattccctgtaaattcaggaactcctcaggggggaataatttctcctgtactggctaacattgctctggatggactggaggcgcttcttgcttcggagtttaaaaagagaacagtcaagggacgattggttaacccgaaagttaactatgtgagatatgctgatgattttattatcactggagagtcaaaagaacttcttgagtctcaggtattacccgtcgtcaggcggtttatggctgaaagaggattaatgctttctccggaaaagacgaaaatcacacatatcgaggaaggatttgattttcttggacagaacattcgcaaatatggcggtaagatgctgatcaaaccctctaaagccaatgtcagttcctttttaaagaaaatacgcgctgtaatcaaaggcaacaaagctatggatcagcttacgttgatccgcatgctgaacccaatgatcaaagggtgggcggcttaccatcaacacattgtggccaaggtcgcatttaacaaagttgacaatgagatctggctggctttatggcgttgggctgttcggcgtcatcccaataagggaaagaagtggattcggaaaagatatttccatcaacaaggtgcccgaaactggtctttctccacggctaccggagaactccttgccaacggtaagcctcagtatgcaaatctgaggaaagcaatcgatacgcctatcaaccggtttaaaccgattaaaattgcagctaatccgttcgatcctcaatgggagatgtactttgaggagcgttgtgcagacaaaatgcggcacaaactgcaaggacggaaaaagctcattcaaatctggtttgagcagcggggccgatgccccatatgtgatgagaggattacatctgattcccagtggcaggttcatcacatcatacggcgagtcgatggagggagcaactgcctctccaatttgattatgctgcatccgatgtgtcacacacttgttcatgcgaaaggtatacatgtagtgaaaccggctcatgagagtgggcttagaaaggcttgagccgtatgccgggaaactggcacgtacggttcttagggggcggtgatgcagtaatgcatcactgctacccgatcgtatgtatttttctggtgaaccggcacagatcgctgagattaaacgactggccagcggtgcagtcacaccgctttatcgccgcgccacaaatgaaggtattcagctgtttctggccggaagtgccggacttctgcagaccactgaagatgtgcggtttgaaccatgccccggactgacggctgccgggcgtggcgttgtatcgccggagaatatcgcgttcacccgctggctgacacacctgcaggacggtgtacttctggatgagcaaaactgcctgatgctgcatgaactctggctgcagagcggtactggccggcgtcgctgggaagaattaccggatgatgccagggaaagcattaccgctcttttcaccccaaaaagaggtgactggtgcgacatctggagtaacgaggatgtatctgtgtggtggaaccgtctgtgtgacaacgtcctgccggaaaaaaccatgccgtttgacctgctgacggttctgtccactcgcctggatgttgaagtgaatggctttaacggtggtgttctgaacggtgttccttctgcatatcactggtatacggaacagtatggcgtgaagtggccttgtgggtatgaggtgaatatcagcagtcagggagacaacttcattcaggttgatttcgacacgccgtggtgtcagccggaaagcgacgttattgcagtattaagccgccgtttcagttgcatgctggagcactggtacgccgggcagggctgcaatttctgtggctggcagcgatatgagcgtggagagcttgttgatgtgctgtggggggaactggaatggtcttccccgacagatgatgatgagctgccggaagtcaccgcgccggagtggatagtcgacaaggtggcgcattacggtggatgaagtatgacggagacgggcgggcaaccgcccgtttcttttccggtaaaggatgtcgccgggctcctctttttactgcgccggctgacgcggcgcggcaggaacgctgcctgtggtcagtgtcccgcgtccggccgggcacgggacgggcgcttttaccgctcccggctggcatcggtgacagtgtacgccagcccgtcgcccttttctgatgaacgcccttcaagccgctttcgcggcatattctcgccgtcaaaaagacgacggctgcgatattccacggtcggcctgacccgttaccggacgcggtgaacagcccacaggccgcggggaacgggcgccacaggggcgccctcccggtgccctctgtaagagaaggagtgctgttatgtcccgttttatccagggtgactgcgtgcgtgttatggccacgattccgggcaatggtgtcgatttcatcctcaccgacccgccatatctcgtcggtttccgtgaccgtcaggggcgtaccatcgccggcgataaaaccgatgaatggctgcaaccggcctgtaatgaaatgtaccgcgtgctgaaaaaagatgcgctgatggtgagcttctatggctggaaccgcgtcgatcgctttatggccgcctggaaaaatgcgggattcagcgtggttggccacctggtgtttaccaaaacctacacttcgaaggccgcatatgtgggctatcgccacgaatgcgcttacatcctggcaaaagggcgtccggcgctgcctcagaagccattgcccgacgtgctgggctggaaatattcaggcaatcgtcatcacccgacggaaaaacctgttaccagcctgcaaccactgattgagagcttcacacacccgaacgcgattgtgctggacccgtttgcaggcagcggctcaacctgtgtggccgcccttcagtccggacgccggtatatcggtatcgagctgcttgaacagtatcaccgtgccggacagcaacgtctggctgccgtacagcgggccatgcagcagggggccgcaaatgatgactggtttatgccggaggctgcgtaaatgaactatgccggacatgaaaaacttcgcgccgacgtggcggaggtggccaacaccatgtgtgaccttcgggccaggctgaacgatatggagcatcgctgtcgctttgattccgatgtgcttgttgaacgcctggcacgccagacgctgtatcgcgccaatcgcctgttcatggaggcgtataccgaaattctggaactggatgcgtgctttaaagattgagaaggagacgagaatgtacggaacatgcgaaacgctatgccgggagctggcagcaaagtatccgggatatacaccgctgatgctggttatctggtccccggaagagattcaggccctcgctgacggaatggatatttccctgtccgatcctgaaatcaggaccgtcctggcgcgcctggaggacatcccggaagaccagcgaattgagtccggtatttcttctgccgcggcgatggagattatcagcaacgtgagcgaaaaccgccaggtgaccgtcccggctgaactgctggcgtccctgattcagaccgccgaacaggcactgtggaaacgtgaatgggccgcccgtgattacggtctcgccgtcccggaatgcgttacccgccgtcaggcggtggttaatcaggcccgcatcctgctgaaaaacaacacacacgaaaacggctgatgttatcgccgcctgcgggcggcgatacagggagaacgattaatcatgaacgaaaacacaacgctgaacgcactgatttgtcgtcacgcccgtaacctgctgctggcgcagggctggccggaagagacggatgtcgaccagcgtaacccgaagtatccgggctggatcagcatttatgttctgctggatgcgccccggctggcgacgttactcgttaaccgccacggcggcgtactgccgccgcacctggcctccgccattcagaaactgaccggaaccggagcggaacttgttctgtccggcagtcagtggcagtcgctgccggtgcttccggcagacggaacgcaggtgtcttttccgtatgccggtgaatggctgaccgaagacgaaatcagggctgtacttgcggcggtgcgcgatgcggtacgcagtgtcagttgccgggtggcagaagatacgcggcgtatccgggcggcgctgaccaccaccggtcagacgttactgacccgccagacgcgccgctttcgcctggtcgtgaaggaaagcgatcacccctgctggctcgatgaggacgacgaaaacctgcccgtggtgctcgatgccatcctgaaccggggcgcacgtttttcggcggtggaaatgtatctggtcagcgattgtattgaacatatcctgtccagtgggctggcctgcgatgtgctgcgtataccggatgaaccgccccgccggtggtttgaccgtggtgttctgcgggaggtggtccgggaagcccggaacgaaatccgcagcatggcggatgccctggcaaaaatccggaaatgatgacgttggcggggtaaatccccgcctttttcctgccggtccccggacagagcacaaaggaagtcgccgctggctccgctttacccggccatgcagggcatggccttgtggtttttcagttatgtggcctcagcgtcgtgtgcgggcggtgccgtgcctccatcttagccgggctggcgttgatgcaagggtacgcttcgccgctgcggtcacccggtccctccttcccgtctgccgtgattttccggtcgttcgcccgctcaggtttcgcggcctcaccctgcaactcccgtcagccgtgtgcgtcaggctgcggcttcccttgcgccctgtgcatccccgccttatcgcccggcttttctggaggcacggcaccgcccggtgtcgcggaatatgtgaacaacggaggaaaacatcatgcaatatgcgaaacctgtcactctgaatgttgaagagtgcgaccgtctctcctttctgccttacctgtttggcaacgattttctgtatgccgaggcgtatgtgtacgcgctggcgcaaaaaatgatgccggaatatcagggaggcttctggcacttcatccgcctgccggacggtggcggttacatgatgccggatggcgaccgtttccacatggtgaacggtgcaaactggtttgaccgtaccgtgagtgctgatgcctgcggcatcattctgacttcccttgtgattaaccgccagttgtggctgtaccacgacagcggtgatgcaggactgacccagctttaccggatgcgcgatgcgcagttgtggcgtcacatcgaatttcaccctgaatgcaacgcgatttacgcggcactggactgattaacggacggggcggcaatgccgcccctgtaaaggagacgagaacatgtactgtactgttaaagaaatcatccgcgatgtactggatacagacgtgccggacagtgaatgcgtttttgccgtggtgctgacccgtggggatgtgcgccacatagcccaggactggaacctgtcagacgatgagctggaaaccgtcatgcagcggctggacgatgcctttgaatatggtgcggatgtcagcattgttcacgacgttgttcgtgagttgatggaagaaaagcgtgccagccgtcaggtgacagttccggcggtgatgctggaaaaagtgatggcgctggcaggcagtgaaatgaagcgcctgtatgccgtcgggagtgagaacgggggcgacggtgatgcgttcgtcagggaggaacgcgaagcaatggacgttgtgttacaggcgctggacggggagcacatgtcatgaatatcagcacagaaacccgcgaaattctgcgcaattacaaagccgtgattaatgcgcgacgtcgtgaaatggggcagaaaccgctcaccaccgcgcagattgttgatgaaatctgcgattttgtggcgaatcagcaggctgttttcctgggcggtcactacatcttacagggcagcagaaacaggtgatacagggctggcggtggaggccgcctgtcagcccgcccgaaaacccctggcaggctgacgcctgccggaagggaagcgggccacgctgacgcgtcgtccgttacccttcctgtttgtgatgtgtccggaatgtttttttctgatgttatttttctgtggttaccgtgcctgttactgttcttcttctttttcctcttcctcttcctcctcttctttccgttcctctcctgcttatggcttttccgggcgtccccctggcggggcgggctgtcgtgaacggagccagcgaagctgtctccgccctggcgggcttccatccctgacgcgaaaccctggcttgcagcgaccgttccggtcgcgcagcctctgtcgcgccgtggcctgcgctcccggcatcccggcaaaaggccgccgggatgtaaggggcaacgccgtttcgcaaaccgcgcttcacgtcgttgcggcgggtccctgctcattgcctgcagggtgccacacacccgtatgagtccctgtcgccgggagctgatacagccacaacctgccgcactgactgtccagggtaaatgaacagcccacaaaattttttacccagaacccggtaaaaaattttgcgttctgcccaggacaggtgtgtcaggccgtggcagtgatgccccttgcggcgaaggttctcaaacgggtgaagttcataccacagggaatacagcagcaggttcccgcgaaacgtcaaaaccgcggctcccgaaactcaacgggtgatgttctttaaaaatcaggatttatttcaggctccggcaatacgcatttatgtgttctgtcagtcatccggctgacaggtaatgagaacgcaggaacagaaggaggaaaacaccggaaagcgtcagatgcagatatgaaaaaagcaggtcagggacctgcttaatccacgccgtaagaattgtgcgaccaattttgacggcattgttaaccaatttgtcataaggaatccatttatgactgtaagcattgtttcaccttccgcagcggctgtaaagccccgccgtcatccccgtttcagacgcgaagacatccccgctccggaaattgaccccgtgctgaaagccttcgggcgacacatagcccggagttttcaccgggggcgtggtgtacacatccccgccatgaaaaacacggctttcgggcaggtgctccgcacactcgaactgaaacgcgcttttaactgatgaggtgagccgccccgcgaggggcggcaacagacggaaggagaacattttatgacatcagcagcaatcaccatgaccgccccggaagccgccagccctgtgcagatgtaccgcgcgacctactcaccggatgacaacaaactgcgcctgtatgccgtgtcacgtcttgacccggagacgtataaaaaagtgcatgatgccggttttcgctgggcaccaaaacaggcgctgtttgtcgcgccggcctggacaccgggccgggaagacgtgctcctctcacttgccggagagattgaggatgaagacagcacgctcgctgaacgtcaggaagcacgggcggagcggtttaccggatacagcggaaagcgggccagtgaatccgcacaggcacttgatgaagtggaaagactggccgcgatgatcccgcccggtcagcccattcttgtggggcatcacagcgaacgccgcgcccgtcgtgatgcgcagcgtattgaaaacggcatgaaacgtgccgtgatgctctttgaacgtgcggaatactgggaagaacgggggcggtcagcactgcttcacgcgaagtataaagaacgtccggacgttcgctggcgtcgtatcaaaaaaatcgaagctgatttgcgcaaggctgaaaagaccatcgcgcagtcgcagaaatatctgacgatgtggcgggctgaatcgctggatctgaatatggcaaaactcatcagcagtcatgaccatatcagcgcctgtttcccgctggatacgtatccgcgcccggcagaaaaaagccagtatgaagggagccggtcattatggtcggccctggatgatgacatcatcaccacggagcaggcccgcgaaattgcgatccgctgtcatgaacggcagattcagcatcagcaacgctgggttaaccactatcagaaccgcctgaactatgagcgtgccatgctggacgaaagcggcggcgtggttacccggacacaggattttgagccgggcggacaggttttcagccggggcgagtggctgaccatcatccgcgtgaacaaaagcaacggggcggtgagttcagtcacaacgccgaattacagttttctcgggtacagcggcacgatgaaagtgacgcccgatcgcatcacggactacaaagcaccatcggcagaagaggctgccgtcgccagccaggccgcgaagcgtccgccggtagtcaactatccgggggaaggtttccgggaaatgacaaaggcacagtgggccgccctgccccgggactgtaaggccgtgcgcagtgtggcagaagcagaagaccacggggcataccgctaccgccgcacaatggacaataatttccgtctggtgaatgtgtatatcaccgacatgaaaattacggaaatcccacagaaataaggtatatccccccgggaaatccccgggggatgacggagataatgacatgcacagtcagttaaaagaacgtatccggctgatgcgcgcaaggctggataacgccgcgccggttgctgaaatccgggctgaatctcagctttttgtgactcctgccccggtctgtgatcgcctggtgacgctggcggagatcagcaaccgtgatcacattctggaaccctctgccggcaccggggccatactgcgggcgattcgggataccgcaccggaggccatgtgtgatgcggtggaaatcaacagcgggctggtccggtatctgcgggaaaattttaacggtgtcagggttcagtgtggcgacttcatggaatggcagccggtgcagtattacagccgggttatcattaatccgccgttcagccacgggcaggatatccggcatatcctgcgggccttttccctgttgcgtccgggtggcgtgctggtcgccgtctgtctgaacgggccgcgccagcaggagaagctgttaccgttttctgacgtccgcgaggagctgccacgcggcacgtttgcttataccgatgttccgacgatgattattcgtctgcgtgcctgatgactccgggcaggcgggaggataaatgcccgtctgcccgcgccgggaaaagaccgcgcgccggtggcgctgaaaggggccgcgctcacgcgccgccccttacattacgcggacattctgctgtgggcttctgtcttttcagacctgtcatttgtctgttactgatgatgttgttgttcatgctactgctactgctactgctactgctactgctactgctactgttcttcttttttctgctgctctgattactgtctgttttgttgttctcctgcttatgccttttccgggcgtccccctggcggggcgggctgtcgtgaacggagccagcggagctgtctccgccctggcgggcttccatccctgacgcgaaacccgggcttgcagcgaccgttccggtcgcgccgcctctgtcgcgccgtggcctgcgctcccggcatcccggcaaaaggccgccgggatgtaaggggcaacgccgtttcgcaaaccgcgcttcacgtcgttgcggcgggtgcctgcccgttgttgtgtccggtgccattcacctgtttaagcccctgtcgccgggggcaaagacagccacaaccgtctccgccagtccaggggtgaaatgcacatcccgcaaaactttttgcccaaaagcaggcaaaaagttttgcggtctgcccccggacagtcgtttccggccgtggcagtgatgccccttgcggcgaaggttctcaaaaaggtgatggtgaataccggagggaacaaaaggcaggtccccgcaaaacgtcaaaaccgcggctcccgaaactcaaaagatgatgggggctgaaaacatcaacagaaggagacacatcatggcagttcgtggcattaacaaggtcatcctcgtaggacgcctgggaaaagatccggaagtccgttacatccccaacgggggcgcagtggcaaacctgcaggtggccacgtcagaaagctggcgtgacaaacagacgggggagatgcgggagcagacagaatggcatcgcgtggtgctgttcggcaagctcgcggaagtggcaggtgaatatctgcgcaagggcgcgcaggtctacatcgaaggtcagcttcgcacccgtagctgggaggataacggtatcacccgttacgtcaccgaaattcttgttaagaccacgggcaccatgcagatgctggtacgtgccgcaggtgctcagactcagccggaagaggggcaacagttcagcggtcagcctcagccgcaaccgccggagggtgacgattacgggttttcagacgatatcccgttctgaacgactgactgtgacaaccgccccgtcctgtgcggggcatcaccggagagatgaggatgagcgaatatttcagaatacttcagggactgcctgacggtccttttacccgcaaacatgccgaagccgttgccgcacagtaccggaacgtctttatcgagaatgaccacggcgaacagtttcgcctggttgtccgtaataacggtgcaatggtctggcgtacctggaattttgaggacggtgccgggtactggatgaaccatgtcatccgtgatttcgggattattaagtaagagaggtgccggacgggaacgcgtccggcagacaatcattattaccgttttgggaggtactaactatgtcagttacagagtctaaggcaaaaacggagcgtaaatccagccgtaaacctgcaaaaacgcaggaaacagtcctgtcggccctgctggcgcagacggaggaagtgagcgtgccgctggcctcgctgattaagtcaccgctgaatgtgcgcacggtgccgtattctgcggagtccgtcagcgaactggcggactccattaaaggtgtcggcctgttacagaatctggttgttcatgccctgccaggtgaccgttacggtgtcgccgcaggtggtcgccgactggcagcactcaacatgctggcagagcgtgacatcattccggctgactggcctgtccgtgtgaaggtcattccgcaggagctggcgactgccgcatcgatgaccgagaacggtcatcgtcgggatatgcaccctgccgaacagattgccggattccgtgcaatggcgcaggaaggcaaaacacctgcacaaatcggtgatttgctgggttattcgccccgccacgttcagcgaatgctgaaactggcagaccttgcgcctgtcatcctcgatgcgctggcagaagaccgcatcaccaccgagcactgtcaggcgctggcgctggagaacgacaccgcgcgtcaggtgcaggtgtttgaagccgcctgtcagtcgggatggggcggtaaaccggaagtacagaccattcgtcgtctggtgaccgaaagtgaagtggcggtggcagggaacagtaaattccgcttcgtgggggctgataccttctcgccagatgaactgcgcaccgatttgttcagtgacgacgagggtggctatgtggactgcgtggcgctcgatgccgccctgctggaaaaactccaggctgtcgccgaacaccttcgggaagccgaaggctgggaatggtgcgccggacgtatggagcctgttggtttctgccgtgaggatgccggaacataccgcagtctgccggagccggaagcggtgctgacggaggcagaagaagaacgcctgaacgaactgatggcacgttacgatgcgctggaaaaccagtgtgaggaatccgacctgctggaagccgaaatgaagctgatgcgctgcatggcgaaggtcagggcgtggacgccggagatgcgtgccggaagtggcgtggtggtgtcctggcgttatggcaacgtgtgtgtccagcgtggtgtgcagttgcgcagtgaggatgatgtggctgataacgattaccgcacggaacaggtgcaggagaaagcctcagtggaggaaatcagtctgccgctgctgacgaaaatgtcctcagagcgcacgctggcagtccaggcggcactgatgcagcaatcagacaaatccctggcacttctggcatggacactctgtctgaatgtatttggcagtggagcgtacagcaatcccgccagaatccgcctggaatgtgagcattattcgctgaccagcgatgcgccgtcagggaaggaaggtgccgcattcatggcgatgatggcagaaaaagcccgtcttgccgccctgctgccggatggatgggcacgggatatgacgacgttcctgtcactcagtcaggaggtgctgttatcactgctcagtttctgcaccgcgtgcagtatccacggtgtccagacccgtgagtatggtcacacgtcacgcagtccgctggacacgctggagagcgccatcggctttcacatgcgcgactggtggcagccgacgaaagcaaactttttcggacacctgaaaaagccgcagattatcgcagccctgaatgaggcaggactatccggtgccgcacgggacgcggagaagatgaagaaaggcgatgcggctgaacatgcagagcaccatatgaaagacaaccgctgggtgcctggctggatgtgtgcaccacgcccacagacggatgccactgaacgcaccgataacctggctgatgccgcctgatgaacaaccacaccgccccgccggagacggggcggcagcaagggagataccgtgatgaaaactgaactgactctgaatgtattacataccatgaacgcacaggaatatgaagatatccgggctgccggaagtgatgcacgccgtgagctgacacacgccgtgatgcgggagctggatgcgccggacaactggacgatgaacggcgagtacggcagcgagtttggcggctttttccccgtccaggtccgtttcacgcctgcccacgaacgttttcacctggcgttatgttcaccgggcgatgtctcccaggtctgggtgctggttctggtgaatgccggtggtgagccgtttgcggtggttcaggtacagcggcggtttgcaccggaagccgtcagccattcactggcactggcggcgtcactggatacgcagggatacagcgttaacgacatcatccatatcctgatggcggaaggaggtcaggtatgagcgcacgttcacaggcactggttcccctcagcacagagcaacaggccgcatggcgggcagtggcagagacggaaaaacgccgcaatcagggaaacacgctggcggaatatccgtatgcgggggcgtttttccgctgtctgaacggaagccgcaggatatcgctgtctgacctgcgatttttcatgccgtccctgaccgcagaagaactgcacggaaaccgtcttcagtggttgtatgccatcgatgtgctgattgaaacacagggcgaggtctgcctccttccccttcccggtgatgcagcagaacgcttgttcccgtcggtgcggttttgtgtcagggaacgcagtcgccataaatccgcgctggtcatgcagaagtacagccgccagcaggcgagggaggcagagcagaaagcccgtgcgtaccaggcgctggtcgcccaggctgaaatcgaactggcgttccattcaccggaaacagtcggaagctggtatgcacgctggagtgatcgggtggcagagcatgacctggaaaccctgttctggcagtggggcgagcgttttccgtcactggccggaatggaacgctggcagtggcaggatatgccattctggcaggttatcgcggaagccagtctggcagcaaaggaggccggtcatgctgtccgtgagatggagcggtggatggtgccgaacaaactccgggaggtgcgtgatgcggcaacaatcacacggattgcccgtaaacagcctgaatgagcgggttattttcaggaaaagtgaatgtggtcagcgtgctggtatatgggctatgatgtgcccggcgcttgaggctttctgcctcatgacgtgaaggtggtttgttaccgtgttgtgtggcagaaggacaaaagccccgtagttaatttttcattaacccacgaggcccctgcatgcttagacaacatcaggatagcctcttaccgcgctttgcgcaaggagaagaaggccatgaaactaccacgcagctctcttgtctggtgtgtgttgatagtgtgtctcacactgttgatattcacttatctgacacgaaaatcgctgtgcgagattcgttacagagacggatacagggaggtggcggctttcatggcttacgaatccggtaagtagcaacctggaggcgggcgcaggcccgccttttcagggctgatgctggtctgactgcactgaagcgcctttataaaggggctgctggttcgccggtggcccctttctccttgctggcattgtacgggcatgaacagcctggcgacgcgggaaaaagcagacgttcagggaatatattgctcagatgtcgattgccgggctgcgtgaagagcccgcacaggactggttatctttgcataaacggctggccagtgatggtctgtatatcacgatgcaggaaggggaactggtggtgaaggatggctgggacagagcgcgggaaggtgttgcactcagttcgttcggaccgttatggacagctgaaaaactggggcggaaactgggggaatatcagcctgtaccgacagatattttcagtcaggtggggacacccggtcgttatgatccggaagccataaacgttgatatccggccggaaaaagtggcagaaacggagagtctgaaacagtacgcctgccgtcattttgccgaacgcttaccggaaatggcgagaaatggtgagctggaaagttgcctggatgtgcacagaactctggcaacggctggattatggatggggatccagcacgggcatctggtactgcatgatggatttgataaacaacagacaccagtacgtgcagacagtgtgtggccgttaatgacgctggattatatgcaggatctggatggtggatggcagcctgtaccgaaggatatttttactcaggttatacccggagaacggttccggggacgtaatcttggtactcaggctgtcagtgattacgaatggtatcgtatgcggatggggacaggtccacagggagcaataaagcgcgaactgttttctgataaggaaagtctgtgggggtacacaactgttcagtgtgagtcgttgattgaagatatgatcgcgggcgggaatttcagctggcaggcgtgccatgagatgtttgcgcgtaaagggcttatgttgcagaaacagcatcatggtcttgtgattgtggatgcgtttaatcatgagctcacaccagtgaaggccagcagtatccacccggatttgacgttatccagggctgagccgcaggcagggccatttgagattgcaggtgcagatatatttgaacgggtgaagcctgaatgtcgctacaatccggaacttgctgccagcgatgaagtggagcccggcttccggcgcgatcctgtactgcgtcgtgaacgccgtgaagcccgtgcagctgcgcgggaagatttgcgcgcgcgttatcttgcatggaaggagcactggcgtaaacccgacttacgttacggagaacggttacgggaaattcatgctgcctgccgtcggcgcaaggcgtatatccgtgtgcagttccgggatccacaattgcgtaagctgcattaccatattgcggaagtgcagcgtatgcaggcgctgatcaggctgaaggagagtgtgaaggaagagcggttgtcactgattgaggagggtaagtggtatcctttgtcctaccggcagtgggtggagcaacaggcggtacagggagacagagctgcattatcacagttacgtggctgggattatcgtgatcgtcgcaaagacaagcgacgaacaacgaatgccgaccgctgcgtgattctctgtgaaccgggaggaactccactttatgaagacactggcgttctcgaagcccgtctgcagaaagatggcagtgtgcgttttcgtgatcggaggaatggcgagttagtctgtgtggattatggggaccgtgtggtgttctaccatcatcaggacagaaatgaactggtggataagctgaatctgattgctcctgtattgtttgatcgtgagccaggaatgggttttgaaccggaaggctcatatcaacagtttaatgatgtatttgcggaaatggtggcctggcataatgcagctggaataaccggaaatggacactttgtaatcagccgcccggatgtggatttacatcgtcagcgtagtgaacagtactaccacgaatatatcaggcaacagaaaagcatatccggggggcatggcgcatcttatgctccagttcaggataatgagtggacgccaccatcacctggaatgtagggatgaggagtggatattaaaaatcttaacttgtattagttaagattttctttgctctgacagagctatggtactgagatctatatgggttgaggagcaatatatgggggtaaagaaaatcgttatactggctattttagtcagctttgtggcgggatgtgcgccattacatccttcaaattgccataaaactacagccctgggtagttgcagttcaggacgttgggatgatcaggatgaatggggggagcaggcacggggaatcagggatgcaattaatgctaaacttgatgatccgcaaaaatggaaaaggaaaaaatgcaggttgcatatggaattctcccgggatggcacggcgttaaaaatatcaaccagtaatggcgataaagcctattgcgaagcgataaagtcagcagcccataaagctaaattcccggccttcaacaatccggaagtttatagagattttcaaaaatccggctttgacatgcgcggttagctacacgacatatctgtagggctaacagaagactgtcaggtcggctgattactggaacctgaggtactttgcctcaggttatgttgacatactcaaaaaaagattcttacattatcccggtaacggcgtccttcatcggcctgtccgttaaactcaggctacctcacacctcacacctcacacctcacacctcacacctcacacctcacacctcacacctcacacctcacaacagcgggtctggacagaaagcggctcttgatgtggattatcgcatggtgtgggctttcagcggcatggtgactggaaagtaacgatattgcatctgtggcaacgaaaattgcagagttggtactctttgaactgcataagtaagcagaaaggtaaggttatgctttgcgattgaaattcagccttaacgtacaataattttcgatatccaaactgcccccctataacagcaaaaggtcccacaagacgctcgtggaatatattttaaaagagaacaaaaattgcaatatgtggtggctccatacagaggattgacaacattcccatgctaattgttaagattcaaattgaagtatatctatctgtcatttttgcaaatgacatgcggtagcataacgttccgggggctcctgtgccgtcatgcgtgacgacattgatcagccaataatggcacgtgaccacagccagatacggccagccttcatccgtacgtaaatatgtgatgtctcccgcccacttctggttcgggccactggcgtaaaaatcctgctccagcagattttctgacacaggctggctgtgtgcgcggtaacagaccggactgaaattccaggaagcttttgccctcagtccgtgacggcgcaggctttccgtcacggtttttactttaaaatggtaaccctgggcacgcagttcatccatcaggcgttgtgcatgaccgggtaaaagcaacgaggacaacgctgtcgcagtgctgacggaactgccgacgtgtacttatccttatccgccagtgatataagacggtaattcaccatttggattgtccgctccacccaacatgttgtttccttgaggttctcacaccagaaaggacatcagcatgctgagcagagaggacttttacatgataaagcaaatgcgccagcaaggtgcgtatattgttgatattgcgactcagattggttgctctgaacgaacggtcagacgttacctgaaatacccagaacctccggccagaaaaacacgccacaaaatggccgaaatggactatatcgacatgcgtctggctgagaatgtctggaacggcgaagttatcctggcggaaatcaaagcgatgggttataccggtggccgttccatgttgcttcgccagttcaggaagacaccggagcagcgctttacgcaggaacacagtctgttcttccggttgctgaaccgtcgatatgaaaaagcgagcattgtgctgacgtccaataaagggttcgccgactgggggagagatgttcggtgataacgtgctggcaaaatattcacccaacgcattgagcgtaataatctgacgctacgcacccgcattaagcggttgactcgtaaaaccatctgcttctcacgctcagttgagatccacgaaaaagtgatcggagcgtttatcgaaaaacacatgttctactaattggatgcaccaccgaatacattaatttatataacaacatcaaaatacattttaggttgtcgctaatcaaaaattattaagtgttacataattagagggtatagatatgattcatcctggctcttctttagataaagcaattaacaatacaagagttaaaaatgttagtactgatgttaaacatggccaaattcaagagagaaaaaggaactttatctataaaaaaaatgatgatatctcatccagatttaaactttacagttcgctcgtaaagcagaaaaatgcgacagaagatgttgttttaataggcaaaatgattttagatgaagttagaagttacagaactatacataatgatcgaaatatcgtaagtaactcaggaaactggaaaacatcttttttatgtaatcttgctagactactatatagcatatttaatggtagtaactatttttgttcccgagagggtgaaaataattcatcccccagttctactctacttactatacatcagcctgaaaagcaggaactattacaacaaaagagtatcaaacatttaccaacaagtaataacatcgacggatacattaaaataagaaaaacaagaggcgctgaagatcaaacaacaactatcactcaaagtttgataattaatgagttgttaaatggagttgatagaaataccatcccttttcagaaaataagtgagctcaatgatatcatacattcatatgaaaatatgcaaattaaaaatagtcgaaaaggtatagaaatacttgttaagcagggagagctgttatcatcattaataaatgttaataaaggaaataaacaattatcagacaatgcatctaaaataataaacttattgggtatagagtatcagtcacataaagtagacatagagccatttatacatgcagtatgggttgctggcgcacctcctgataatacattttcatatataacggcatttttaaatacatataaagattatacctacctgctctggattgatcctaatgcctttggtgcggccaagtttagtgggattttaaaaaatatagcgatgaattatgcaattatgcgtttgagaagaacgaatccacatttagcggaagaaatgaatgaagtgatattaaaaatacaaaacatacaaaatgaaactatagaatttaaggaaacaagagaaagattgaaggaacttgaaaatagatataaatcattaacgagtgaaactaaagaaaaattcaatgttttttttcttgagtcaatgataggtatgcaagacaactattttacatattgtatatcaaacggaatatcaaatactgatgatatatccagacttgactttttaactaacgttttaaaactttcaccagaagttcaaaatgactttaaatctacagtagagaaaaacaaaagagatatagacttattaaaaaatacaatatctcaaaaatttggggatagatttcaactgagagatattaacacattggagtcatttaaaaaaccacaagattattttttttatcaacaagagatgctattaagatggaactacgccgctgcatcagatcaggtaagaattaatatattgaaagagtatggagggatttataccgatacagatattcttcctgcatattcagataaagtatcacagataataaatgaaaaaagtgatgataagaggttttttgaagatttaaaactaagaaggattatatcagaatctattctgtctctgataaaaggggaaaagtactcaattaaacatgatggattagatgaaacaacactaaatcagttaaataacatattgagtgaaatagaaaaactgacgatagatgattattttaaacccgttgagacaaaagttgtcagagatacatttaaaatttttaaaagatatcaaaaatggacagaaaacacctggaatattagagggaataataatttcatgttaactcacaagggaagtaaatgtattgattttattctatcaggacagaaaaaacagtatttagaactccaacgcatcagagataatataagttataataatctattttatactacagaggatctaaagtctttaaataatgtggcaataggaggaatacctgcaaagaaatatttagaacacggtttgttttctgaatatagacaggacggtacaattccttatgtggttagcactttaaatatatctggcccagacatgattatgcgacaaatgaaaaaatactataaatctcttgggcgcataggtgaagtgcatattaaagataataaattgagtgatgttaattttttgggtgtatatgcaagttcaaataaagacaataaaagttttaactggctaaatccagtgagtgttggtattaatgatattacaccagatgatgaaagctcatgggctgtcagaaataatgatataaataaaattctattcgaaaaaataaactgccatgtacccgaaaaactacctacctccctatactatgaaatcgattcgcggtctttttttcaggggtgggataataaaagcataaagcatgttacagagattaataaagacctcatcaaagatattaatttattattaacatcgtctaatattgatgttaaacttttaataaaactggatcgtgaattatatgcgattagcagtaaaatagataatccgttggccttgcgctctataagaaccttacagctacaattagctaattacgtaacttcgaatacatttgaacctgaaaacacaattaattttatttatgatttttatagaaaaaaacaagatgacttactcagcgcaataaaattattttcgcgtaatgatgccgatacaaaaattattgtctggtacaattccgtaatggaaaaaaatgtgtttctccgagaggttatatcatgtgttctacgaagtaaaaaagtagatagttatataaatgaaaacaaaaaaaacttatctaaggaggatgccggagctttaagagattatgcaaaattaaaaatgaaagaactattttcgatgttagatgatgatggttataaaaaaatcataactacaaatgcatatattaaagagagggataaactatcaggcattatatacaacatcgaaaattcgattatatcgggtcatgaatcatttgatataatacgaagcaatcaacatgagtggggggatttatcaacggtagagcaatttaaaaaatttgagttttatgtgaaaagtgaattatcttcggctaagtcaattttcgatgatataaaaaacaaatatataacagatcctgaaacaaaacgaaacgtactctaccatcagttagatagtgatattaaagagcgaatagcatttctcgatatatcccactatgcatatccgggtagtttattagaaaaattacaattaagtggctacgttttttctgatatcaacataattgcagaatacttattggctagttacggagtttctggacattattctcacggcgtggtatatccagctccatctgataaattacttgagctattaagaagacatacaaagagcaattctgagtggatagaaaaaataaccccatatgtttatgatatattatccgataatgtatccaacgtcttgcgcccccctttatcagaagaacagaaaaaaatattgaatgatataaaattagaaattagtaaatctgtatcagaacagtatttcatgaagttgacagagcaaaaatcatcagttattggtattaaatattctgttgattttgacagatacaatgagaatttgtttttgtctttacctataaatcaaaatttaacgctgccttttatgtatcgctacttcgagatgctatatgacattcacattggaataatagaaaacaaggcaaacagggagtttatatatagtaagttttcatctttaaacctggattttttgattaatgacgagagagttttgaatcttgaaggtttaataaaaaaatataaatatttatcgctgagtgaaatacatagaactttaacaaatagtacttcatttgcagatatttctataccattattgcagaccatatgtcccagcataacaacaataataaaaaaaacagaatattatgggcatcagttaacaaatgctatgactgttgcttcagtggttaaaccatatgactttagcaatcttggtgccataaatagtatagataaatccgtttctgatgtgcctgcattgcatacaattgttgaacaagcaaaatataatttactttcatggaatgatttttataacactcatgcgtcaatatgggatacaatagcaagacagcataaaagtacaaatatcgaatttcacccacaaagtcttctttttgatagagattcgaaaggaaagtgccttggtttatctcttctgtatcttgatacaggggggtacggaggcggatatcaaaaactgaggcacaatattgacactgccagcacattatatcaaacaaaatacaatgacaatctaaaattatctaaccgtgatgatttctttttaagaaaaacacagcgtatcattacaatgtccaatgagttaggtaataacaggttaaaaaatgcacagttagaggttctggaattgaaagaccctatactaactgaaggcatattataccagcgtcgtatatcatctcttttaataacaacagaatatcattcacttgcattacaacaaatatcttctttttggagagtaactgatcctaattttggtcattgtgactttcattccttagcacaggctttaacgtttataaaaaatataacgagcaatcgtaacttttcatctttatatggaagtggcattgttaaaatttacttcagtgaatctcttaataattggaagtatattaagctcccccttgttcagactggttctttgttaagagacatatatttaacaaccccagaaaaattatccacaagcgggggttcattaaatattatggggcatctcgtgcctgtcagttttatttatgatatcggaggggttattaatggtaacagaataagtgaaagtacagatgtgaaaaataaaattaggagcttaaaaataaatggagatattttacaacattatataaatacgcattatttgtcagaggagcaaactcagaagataaaagatattgtggattttttaggtattcaggataacacaataaaagttaagcttgaaagtgatattaaacctataagtgaaatccaacagccccttcattccattctttcacggcagaaagaacacgtaaagaatttactatctggattgcttgatgagttttcaaataagttaagaaagcaaggtctttcacttaaaacaaatgttctttcagttaataacttcaaagaatcaaagataaatagtgatacagtggaggttacagtaacagatctgcaaggaagactttatcgtgttgatatagatacaagagttattggcttaacttttaaagaggggataaatagtttatccgaagcactcgaacacatgaatatcgatgcgattatgtctgttattggcttggttcaatatgcacgaatgataaaaatgaatgacaatattagtgcaatagatcatgcaggagcagtatcagatataaaaaatattgtagacaaatttttaggcggcattttgactcttactaataatcgcgtatataatcctggcggtgtatctggtgcctcgcttgaaggatttacatcttctgggttggaggtgtgtgcttcaagaatgggtggcaccgcagggcgttatcttagcaatgtggcaaaagtaattaaattacctttgctagatataggcataaatatttggtcattatatgattcttcattaaatcatgctaaagccaccacacaaattgaatatatatcaacagcaatagatgtatctttttcatctataaatacagctttgtcaataggcgcaatcgcatatcctcctttggcaatagctatagttccgataactattttttctcatgaagtaaaaaactatgctgtttatgtgaatcaaattaatgagcgccataagttatggctcgaagctgaaaagtatctggacaatggaagtgcaaaggttctaagcattaacaaagccacaggcataatcgatttatcaaataatcaggtgttaggtaatatttatttagatatgagagaaaatcctccaatattacacggtgagaaatcatataatagcggaaagaatattggtagtcatcctgatatgactgacagagagattatggagtctagagcatacaattttgcatgcacaaaactctcagatgcaggtgaacccgatattttcggttggggagataaggaaatatgtaattcaatggaattatcagaatcacaattagctaatgggtattctaaccgccaatggccttctcagattccagttattccagaaggaatttataatacagtatatcttggatatggagaaacattgcgagctaatactgaagttacattgagtagcactggttacttttacgagattgcaagggcatatactgatgatgaactatctgagccattattaacagtatgtaaccaacatagtcatgttattggtggaaaagaaccattaacaattattattcccgctattgaacatggtatgcttggctctaatctacatatgattgaacgttttaaaaactataatttctcgatatcaggagggaagggagggataaaattaatggttggtggtattggtgattacaacatagaatgtacccccggtgttagaaatattatatcgtttgaacaattatcacgtgacttcaatctggatttggatttatcagatgggaggaaacaaaattttaattttcatcatccctcaggtttttattcaggaaaagttatgagcataacgcaaaagggtataaatgcggttgttggtactaaactgggatatgataagattcgtggtaataatcttgataataccttttctcttgggagtggaggaggtgttatatattctggaggagggagcaatacctatttcgttcccgccacactacaggataatttacacatatatatatcagaaaaatcaaatggcaatcatattatattaggtgatatgcactctcgcctatctattgaatgccactttagtaataatgaaagagagtttataaagatgggctactataatggatgtgatgtgattttagaaagtgacactatacaaaaaataaaatcatttgcaaaaaatataacaatacagacagcggatggagttatggcaaattgggatgataaactaaatactctgtctgtttattcaatagatatgattgcatggagggataaaaataaaactgcaaaagaaccgttaccagttgatgtaatccagttaactaattggaggatgcataacacatgctctttattttatgataaatatcaagttgatattgaagccaataagttaacgtatacagtcttatttcctgatacggagttacccgttcagctcaattataccagtattatttatggtaatcatggggcaaaatacaccttcctcaattcaggaagtaaaactatagatattcacattcttgataaaaatagtgattatgatacttttgacttccgtaatattatttttgaacattacaccaatgagatatttataagttttgataatcaaggaggatttgttatatcaatattaaataatgctacgagtgaagcggcgaacattaatgtattccgaaaaaacatgacttctttagatagtagtggttcattgatatatttgcctagcggtgatatttatcatatttcagatatctataaaatgtccagaggtagaaaatcgtttaaattaaatgtagaaaagaaacctgacattgatgatatcatcaatgtggctattttagaaacttcttatctacaaataaaaaaaatccccaataatgatgatagtgattatattttatgtttagacaaccctaacctctcatcttacacattgaactttaatgacttgtctggatacatatcaagtttatgggataatattaggggtagttttaccccttttcataaaaatactgtaaacatcgcccctaatgaaaaaaaatatatttccctaatcggacttgataagttgtcattcaatattgatgtttttagacaagcattagaggtaaaaaataagaatagttacaagataagtaaatttacatgggaaacgtatggtgatatcgttgtatcacctgaagatagaatttctcatctggagttagatgggtttaattatttttcacaacccgagttagatactccaatatctgactcattttcatatttatatgataattttcagatcgttgatagtgatgtgcatattaagcttcttcatctcaacagagaaacaaagcaaataacaccacatcgtattattcttaaaagatactttatagactcatttgctaaaacaagtatcactgacagagaaaagaatatatatcctgtgatttgtgattcacctgatcacttcacaagcgacatatataggcatccatttagaatagttctcgggaataagacattgtatccatcagaagaacttgtaaaattcataagcacctcaaaagaatatttaagcaatatggatgtgattaacaatgttattgttcctcaaaaaacaacaaagaaaaacaaattatccatagttagtttaaatagcaatatcaaaaatgatattgtattgtccggagtaatgaccggaacatcaaagatttttcatctaaataattcaggtgatttattgttaacaacctcaaaaactcatggtggtggggttgtggttatttttaaagattttataaataactggtggaaatataatcttactttaataacagttcctattgataataaattgtcagacaatagaataaatataaccccaatggggataaagatacaggaaacagtcagtggaaatgacaggttgtttttttaccctactccattaaaaaatggatgttttatcttgcataatccactttactctaactcattcccttctttatattcacatgaattatttgatttgattgaagcatatagaaatccaacgtattcgtatttacagaacaatattatcaatagatatatacatactgtttctgagtatgctggaaaagacggtattgccaatatgtcattatctatatacgcatactcgacatgtcgtttctggtcaaaagaaagtgtggctgtaggagatacaataaaattgtctaattatgagcatattgagtttagctttaattcatttagtaaggattactttcgtgaacaaaatagtgatatatataaaatattttttaaaattgcttcttcgagtaattcggttgttgtggataaaaatacgctcactcaaaaaaacttcctagaaaacaatacatttttcagtattacaggtatagatgagtctctctatgaaaagcatataatctttatcactcttaaggttattgtcccctcaaaaaagtagcgctgatttcctgtatgcggaatttgctgactaatcttacccagcatcagcagacgttccaaaggccacgacatacttcgcgaaacgcctgatggatgaactgcgtgcccagggttaccattttaaagtaaaaaccgtgacggaaagcctgcgccgtcacggactgagggcaaaagcttcctggaatttcagtccggtctgttaccgcgcacacagccagcctgtgtcagaaaatctgctggagcaggatttttacgccagtggcccgaaccagaagtgggcgggagacatcacgtattgtgtgcccggagttcagggcgagcatggaggctcaaatgaaccacgagtctgtctggaatattgaaccggtaactctctcctttgatattcagcgtggttgagtgatgtagcagccggtccaggatcgctgttgccagcacatgctctccgaacatttctccccagtctgcgaaccctttgtttgacgtcagtatgatgctcgctttttcatatcgacggttcagtagccggaagaactgaacgcgcagttcacgattttcacgttccagctctttcagacgctgacgttcagcggtggtgagtccaccatcaccactcccggtatcccgctcatgctgacgaacccacacacgcagagtctctggtgtacagccaatctttggggcaatggaacaaattgccgcccattgtgagtcatattcgccctgactttccagaaccatacgaactgcccgttgacggacctcgggggaaaaacgagtatttttagtcatcctgtttacctctttctcagggagtttagtctccaggatttccggggcggttcaatcaccggattgccggtatcagcagggatgacgggctgataactctgcaggatgcggaaggtaacacgcggctgatttcgccccgggaggcggtggctgaaggcgtcacactgtaccccccggacaccatcagggtggggaccggtgaccggatgcgcttcacgaagagtgaccgggggcgtggttatgtggccaacagcgtctggacggtgacagcggtttccggtgacagtgtcacgctgtcgggcggacagcagacccgggtgattcgccccgcccaggagcgggcagagcaacatattgacctggcctatgccatcaccgctcacggtgcgcagggggcaagtgaaacctttgccatcgcgcttgaaggtacggaaggcagccggaaactgatggccggctttgagtcagcctacgtggccctgtcgcgtatgaagcagcatgtgcaggtgtacaccgataaccgtcagggctggacggatgccattaacaatgccgtacagaaaggaacagcccacgatgtgtttgaaccgaaaccggaccgggaggtcatgaatgcagagcggctgttcagtacggcgcgggagctgcgggacgtggcggcagggcgtgccgttcttcgtcaggcggggcttgccgggggagacagtcctgcacggtttattgctccgggacgtaaatatccacagccgtatgtggcactgccggcgtttgaccgtaacggcaagtctgccggtatctggctgaacccgctgaccacggatgacggaaacgggctgcggggattcagtggtgaaggacgggtgaaaggcagcggggatgcgcagttcgtggccctgcagggcagccgtaacggagagagcctgctggctgataatatgcaggatggtgtccggattgcccgtgataatcctgacagcggtgtggtggtgagaatcgccggtgaaggtcgtccgtggaatcccggtgccatcaccggtggtcgcgtgtggggggatatcccggacaacagcgtccagccgggagccggaaatggcgagccggtcacggcagaggtactggcacagcggcaggctgaagaggccatccgccgtgaaacggaacgccgcgcagatgaaattgtccgtaaaatggcagagaacaaacctgacctgccggacggcagaacagagcaggctgtcagggagattgccgggcaggagcgtgaacgggctgtcacttctgaacgggaagccgcgctgccggagagtgtactgcgtgaaccacaacgggagcgggaggcggtccgtgaggttgtccgggaaaacctgctgcaggagcgactgcagcagatggagcgggatatggttcgtgacctgcagaaagagaaaaccctgggcggagactgatacaggaagacaaacactgatgacaacggataacacgaacacgacacgtaacgattcactggctgcccggaccgatacctggttgcagtcgttgctggtctggtcacccggacagcgggatatcatcaaaacggtggcactggtgctgatggtactggaccacgcaaaccgcattctgcatctggaccagacgtggatgtttctggccgggcgtggagcctttccgttgtttgctctggtgtgggggctgaatctgtcccgccatgcgcatatcaggcagtcggccattaaccggctgtggggatggggaattattgcccagttcgcgtattatctggcaggctttccgtggtatgaggggaatatcctgtttgcctttgcagtggcggcacaggtgctgacgtggtgtgaaacgcgcagtgggtggcgtacagcagcggccattctcctgatggcactgtgggggcctttgtccggcaccagttacggcattgccgggctgctgatgctggcagtcagccaccggctgtaccgggcggaagacagaacggaacgtctggtgctggttgcatgcctgctggccgtgattccggcacttaaccttgcctccagtgatgcggcggctgtagctggtcttgtgatgacggtgctgaccgttggtctggtgtcctgtgcagggaaatcattaccccgtttctggcccggagattttttcccgacgttctatggctgtcatctggctgtgctgggcattctggcgttgtgactggtatgatactgacgctgattctgcttattaataaacaacataacacaggatatttatgaaaattacggatcacaaactctctgaaggtattgccctgacatttcgtgttcctgaaggaaatataaaacatcctttgattatcttatgccatgggttttgcggtatcaggaatgttctgctcccttgctttgcgaatgccttcacagaagcaggattcgcaacgattacttttgattatcgaggattcggtgagagtgatggagaacgagggcgtctggttcctgcaatgcagaccgaagatattatttcagttatcaattgggcagaaaagcaggaatgtattgataatcagcgtattgggttatggggaacatcgctgggaggggggcatgtcttcagtgcagctgcgcaggaccaacgcgtaaaatgtattgtcagccagctggcttttgctgacggtgatgttctggttaccggagagatgaatgaatcggagagagcgtcttttctatccacgctgaataaaatggcagagaagaagaaaaacaccgggaaagagatgtttgtgggggttacacgggtactaagtgatgatgaatcgaaggtattcttcgagaaaatcaaagcccggcatcccgaaatggatataaaaatacctttccttacggtcatggaaacgttgcaatataaaccggcagagagtgcagccagcgtccagtgcccagttttggttgttattgccggccaggatagcgttaatccaccggaacagggaagagcattatatgatgctgttgcttctggtactaaggaattatacgaggaagctgatgcatgccattatgatatttatgagggcgcgttttttgaacgtgtagtagctgtgcagacacaatggtttaaacaatatctttaattgtcagtatttatacgttaaaggtcgttgaaattaacttcctgttacgatgagccgtttcaacggcctgcagggcatattttcacgaaggtcagagtaagcatggcagagcaaaaacgaccggtactgacactgaagcggaaaacggaaggagagacgcctgtccgcagccggaaaaccatcatcaatgtcaccacgccaccaaaatggaaggtgaaaaagcagaagctggccgagaaagcagcccgggaagcggagctggcggcaaaaaaagcgcaggccagacaggcgctgtccatttatctgaacctgcccacgcaggatgaggccgtgaacaccctgaaaccctggtggccgggattatttgacggtgacacgccccggcttctggcctgcggtatccgggacgtgttactggaagacgtggcgcagcggaatatcccgctctcgcataaaaagctgcgcagggcgctgaaggccatcacccgttcagaaagctatctgtgtgccatgaaagccggtgcctgccggtatgacacggaagggtatgtgacggagcatatttctcaggaggaggaagcgtatgcggcagcgcgtctggataaaatccgccgccagaaccggataaaggcagaacttcaggccgtgcttgatgagaaataaaaaaagcctccctcagagagaggaggcagggaaataaggcttaaaaggaaataacttccgtacccgaaaggaagccaattcagtagattatttaacaccataatactgacgggttaaagaggagtgataaagatgaatggattcagaaacagttcacggaacggtcaggtctggcgttaccagcgtgccggaagccgggccgttattctggaagtcagtggacgctggatggaagcggcagaagcatggcgacgggctgccggtgttgcaccccggactgactggcagcagtttgcccgaaaaagggctgaacactgccaccggcgctgccgaggaagggggtaacgaaaaaagcagccttcattactccagggattcagaaggctgaataatgcatgagatttgctttttttaatatccggtcgggcagtatgaccggccagttctgagtagcacagagttttttccgtattaagtcgtgattttatattttgtgattaatttcacaaaataaggtgttattaagtgtgtgctgcaatattcaggatgcctgaaatacaggtgctatttatctgatacggagaataacatgaggaaatatattccactggtattatttatcttttcatggccggtattgtgtgcagatattcatggacgggttgttcgtgtactggacggtgataccatcgaggtcatggactcacggaaggcggtgcggatcaggctggtaaatattgatgcgccggaaaagaaacaggattatggccggtggtcgacagacatgatgaaatcactggttgcaggaaaaacggttaccgtcacatattttcagcgagatcgttatggtcgtatgctcgggcaggtttatgcaccagacggaatgaatgttaatcagtttatggtccgggccggggccgcctgggtatatgagcagtacaacacagatcccgtgctgcctgtccttcagaacgaagccagacaacaaaaacgtgggctctggtcagatgctgatccggttcccccctggatatggagacaccgtaaataaagcgatggcaatcttatcattcatctgttctcagcgggaataaaaatggaaaaaacaaaacaggaatggctgtatcaattacggcgatgttcatcagtcaatacgctggaaaaaattattcataaaaacagagacagtttatcgaccagtgaacgtgaatcatttaattcagcagcagaccaccggttagcagaattaatcaccggaaagttatatgacaggataccaaaagaaatatggaaatatgtaaggtaatagttcagcataattaattaccaggagcagataaacaatgaagctgattatttttattctcattgttctgattattgcagcgttacttatccggattatcctcagaagtgtaaatcagcattctcctttgctgatgcaattgcatgcggcaggtatacggaccggtgatgcagagcgaatactgtccggcggtgaatatgatgccagccatttacgacctgaacgcagacgccgggatattcttctggaagaggttctgaggcaggctggtattccgttgctcagaagccacgatgccagaaaactgctgcagatgaccggagaatggctgaatacaacaggggctgctcagcagtcaccggaacatcgtagctgacgccttcgcgttgctcagttgtccaaccccggaaacgggaaaaagcaagttttccccgctcccggcgtttccataactgaaaaccatactatttcacagtttaaatcacattaaacgacagtaatccccgttgatttgtgcgccaacacagatcttcgtcacaattctcaagtcgctgatttcaaaaaactgtagtatcctctgcgaaacgatccctgtttaagtattgaggaggcgagatgtcgcagacagaaaatgcagtgacttcctcatctggcgcaaaacgagcatacagaaaggggaatccgctttctgatgcagagaaacaaagattatcagtggcccgtaaaagagcttcgttcaaggaagtaaaagtatttcttgaaccaaagtataaggccatgctcatgcaaatgtgtcatgaagatggcctgactcaggctgaagttctgaccgcactgataaaaagtgaagcgcaaaaacgatgtgtgtgatgatgggcttacattcttgagtgttcagaagattagtgctagattactgatcgtttaaggaattttgtggctggccacgccgtaaggtggcagggaactggttctgatgtggatttacaggagccagaaaagcaaaaaccccgataatcttcagaaagtttggcgactgagaagattaccggggcccacttaaaccgtatagccaacaattcagctatgcggggagtatagttatatgctcggaaaagttcaagacttctttctgtgctcgctccttctgcgcattgtaagtgcaggatggtgtgactgatcttcaacaaacgtattaccgccaggtaaagaacccgaatccggtgttcacaccccgtgaaggtgccggaacgctgaagttctgcgaaaaactgatggaaaaggcggtgggcttcacctcccgttttgatttcgccattcatgtggcacatgcccgttcgaagggactgcgtcggcgcatgccaccggtactgcgtcgccgggctattgatgcgctgctgcaggggctgtgttttcactatgacccgctggccaaccgtgtccagtgctccatcaccacactggccattgagtgcggactggcgacggagtctgctgccggaaaactctccatcacccgtgccacccgggccctgacgttcctgtcagagctgggactgattacctaccagacggaatatgacccgcttatcgggtgctacattccgaccgacatcacgttcacaccggctctgtttgctgcccttgatgtgtctgaggatgcagtggcagctgcgcgccgcagccgtgttgaatgggaaaacaggctgcgcaaaaagcaggggctggataccctgggtatggatgaactgatagcgaaagcctggcgttttgtgcgtgagcgtttccgcagttaccagacagagcttaagtcacggggaataaagcgtgcccgtgcgcgtcgtgatgcgggcagggaacgtcaggatatcgtcaccctggtgaaacggcagctgacgcgtgaaatctcggaagggcgcttcactgctaatcgtgaggcggtaaaacgcgaagtggagcgtcgtgtgaaggagcgcatgattctgtcacgtaaccgcaattacagccggctggccacagcttccccctgaaagtgacctcctcagaataatccggcacgcgccggaggcattcgcacgcctgaagcccgccggtgcacaaaaaatcagcaccacatcccaaaaacaacctcatcatctaccttctggtgcatccggtcccccctgttttgatacaaaacacgtctcacagacgggcaattttgtttatccacattaaactgcaagggatttctctgtaagattacaaccgttcatgtcataaagcaccagccgccaggcttacagggtgcaatgtatcttttaaacacccgtttatatctcctttaaactacttaattacattcatttaaaaaaaagacttattcactgcctgtcctgtggacagacagatatgcacctcccaccgcaagcggcgggccccaaccggagccactttagttacaacacacaaaaacaacctccagaaaaaccccggtcccgcgcagaactgaaaccacaaagcccctccctcataactgaaaaacggccccgccccggcccaaagggccggaacagagtcgcttttaattatgaatgttgtaactaagcatcatcatcgctgtcagtcttctggctgaacgttctcagtacacgctcgtaagcggccctgagggctcgctaacgcggagatacgccccgacttcgggtaaaccctcgtcgggaccactccgaccgcgcacataaactctctcatggctgaaagcgggtatggtctggcagggctgggggggggtaaggtgaaatccatcaatcagtaccggcttacgccgggcttcggcggttttacacctgtgctacatgtaacctccgtataccgccttacatgcgctgacgcgcattatttgccttgttccgtctgaaagtaatcactatgattaaatatgattaacgactaatcggatatgcaaatgaaaaacaataccgcacaagcaacaaaagtcattaccgcgcatgtgccattacctatggctgataaagtcgaccagatggccgccagactggaacgctcccggggttgggttatcaaacaggcgctttctgcatggcttgcccaggaggaggagcgtaatcgcctgacgctggaagccctggacgatgtgacatccggacaggttattgaccatcaggctgtacaggcctgggcggacagcctcagtactgacaatccgttaccggtgccacgctgatggaactgaagtggagcagtaaagcgctttctgatttggcgcggttatatgattttctggtgctagccagtaaacctgctgccgccagaacggtacagtccctgacacaggcaccggtcattctgttaactcatccacgtatgggggaacagttatttcagtttgaacccagggaggtcagacggatttttgctggcgagtacgaaatccgttacgaacttaatggccagactatttatgtattgcgcctgtggcacacacgagaaaacaggtagattgtgtgtggggacaacttaacatagcctgcagatattaattctggaacattattatcaggccagatatttaaataatcttgtaggagataaaatgaattacgatgaaataacgaaaattaccgctgaacgtattagcgactacatgactgaagcagttaatacagactctatagccgttgcggaaatgtttcataacgcagcatggggagtgcgaacattgtggtttgaactcgtcacaaaaatagatatagatatacataaaaagaacagatatgcgagttatgatcttgatcgataggaatttaaatcccaaaaagattaaaaaaacacccaaaaacggatgtttattcaacactgcctgcgtgccatgagtgcaccgccgtcaattaaatggatctatttcatcctgaccagcatagtgctccagacggctcatcggcaccggcggttttttcaggtaagagccgaagtacaccgccacatgtgtggcgttatccatcacccgggatacgttgacattccagccccgccggtaatgactgtccaggaagcgattcctgtcccgtttactgcttccttctgctgccagcgcatccggtatcaccaggtccggtgaggtgtactggcaatagcggacactaccatttgttctttttttaagcagccatctgatgatatttttccctgaaggctgccggggagatattccccagacgagagtgacgacgctgacgattgtagaaaatctcaatgtattcccgtattactgagatggcttcatcccggttattaaaacgatagtggctcaggctctcatttttcagcgttccccagaagctttccatcggagcgttgtcgtaacagttacctttacgcgacattgatgttttcagaccaaactgctcctgtatgacccggtaatcgtatgcgcagtactgtgaacctcgatcagagtggtggattagcccggcaggtgggcgctggctcctgagcgccataaacagggctttacctgtcagctcttttgtcatgcgctctcccatggcgtagccgacaatttcgcacgtataaacatctttgatgccagcgaggtacaaccatccctcctgtgtggcaacatacgtcaggtccgccacccagacctgatttggtgctgcaggagcgaacgtctggttcagcagatttggcgcaactggcagattgtggttcgagttcgtagtcgcacatctgcctggcggcagatttcctgtatcacatccgcagcaatgcggctcatctctgccagtaaccaccggttgtggaacaccagggaccagtactggcagggaagtgtgaacacaatatgctgccacggacagtcgggaaccagactcagcagatactgtatccactgtgcgccagccttcactccgcagtgcgggcaggagcgacttttacaccggaagcagaccttttttatgtggctgcagtccggagatgaacagcaccactgtgtgtaccccatcagcgtggtcccgcaggccatgatttttgtcacagactcaatgactaccggacgcactgaaccttccggttgtttctccagccagttaagccagcggtttccctgctgaaaaatgtcggcaaaacggggaagcatcagaagggcgggggaactccgtccggccagtgaaccgtgccacactccgggcagtacatgccgccggcgctgataccggcaagaatggtcgcaaactcccgctccgtgcagcgggctatttcaggatacccttcgtcatcaacacgtacaaaccagaagaccagctttttgtttctgacatccacaaagaagggaatattcaggtctgcgcagcactcaacggcatcgtcagttgcggcttggaaccccttagtattttttgtctgtagtatctatcccagcaataggtatatcctgttgcatcaataaagttgacttttgtatacaacatgcgaatttcccttaatccggagctattcgtatgataaaaaaaactcttcctgttctgattcttctggcgctatcggggagcttttctaccgctgtagccgctgataaaaaagagactcaaaatttctactatccagaaacactggatttaactcctctgagattacacagccctgaatcaaatccctggggggctgattttgattatgccaccagatttcaacagctggatatggaggctctgaaaaaagatatcaaagatttgctgacaacttcccaggattggtggcctgcggattatggtcattatggtcctttctttattcgtatggcttggcacggtgccggaacatacaggacatatgatggccggggaggcgccagtggtggtcagcaacgttttgaaccgctgaacagctggccggataacgttaatctggataaagcccgtcgattgctgtggccagtcaagaaaaaatacggctccagtatttcctggggagacctgatggtcctgactggtaatgttgcccttgaatccatgggatttaaaacgctgggatttgctggcggaagagaagatgactgggagtcggacctggtatactgggggcctgacaacaagcctcttgcagataaccgggataaaaacgggaaacttcagaaacctcttgccgccacgcagatgggacttatttatgtcaatcctgaaggccccggtggaaaaccagatcctctggcttccgcgaaagatatcagggaagctttttcacgtatggccatggatgatgaggagactgtggccctgatcgcgggagggcatacatttggtaaagcacatggtgcagcgtctcctgaaaaatgtattggcgcagggcctgatggtgcacctgtggaggagcagggactgggatggaaaaataaatgtggtacaggaaacggcaaatataccatcaccagtggcctggaaggagcctggtcgacatcgccaacccagttcacaatgcagtatctgaagaatttatataaatatgaatgggagctgcacaagagtcctgccggtgcttatcagtggaagcctaaaaaagcggcaaatatagttcaggacgcgcatgatccgtctgtcctgcatccgttgatgatgtttacgacggatattgctcttaaagttgatcctgaatataagaaaataaccacccgtttcctgaatgatccaaaagcttttgagcaggcattcgcaagagcatggtttaaactgacccaccgggatatgggaccggcagcccgatatcttggtaatgaagttcctgcagaatcatttatctggcaggatcctcttcctgcggcggattatacaatgattgatggtaaagacattaagtcgctgaaagagcaggttatggatttgggtatccctgcatctgagctgataaagacagcctgggcttcagcttccacatttcgtgtgactgattatcgtgggggaaataatggtgcccgcatcaggttacagcccgaaattaactgggaagttaatgagcctgaaaaactgaagaaagtactggcatccctgacctcattacagcgtgaatttaacaaaaaacagtctgacggaaagaaagtgtcgttggctgatttaattgttctttcgggtaatgctgcaatcgaagatgcggccagaaaagccggggtggaacttgagattccctttactccgggaagaactgacgcctctcaggagcagacggatgttgcctcattcagtgtactggagccgacagcagatggattcagaaattattactcaaaaagcagaagtcatatatcgccggttgaaagcctcattgataaagccagtcagctggatctcaccgttcctgaaatgacggcattactgggtggtctgcgggtaatggatattaatacaaataattcttcgttgggagtgtttaccgatacccctggtgttctggataacaagttttttgttaatctgctggatatgtcaacacgatggagtaaagcagataaagaagatacatacaatggattcgatcgtaaaacgggagcattaaaatggaaagcatcctctgttgatttaatcttcagttcaaatcctgaattacgtgcggtggcagaagtatatgcctcggatgatgcgagaaataagtttattcatgattttgttaaatcgtggaataaagttatgaatagcgatcggtttgatttaaacaataaatgataaaactgatgagggagggcacctccctcatgaaggagaaattatgcagaaaagcaataaagttataatcagctgtggtatggcattatagtttttgtgtggggggattacagtggcagaagaacttgatgaaagcatgcaagttcttgcaaggaatatgagtgtacttcagtcatcaatggataaaaaggagcttcttgaagctcttgacagaatggatgatgctgtagatgagtcaatgaagcgtcttcctgagagcatttcaccggctgatgaagaagggaagaatgactatataaaagaacttcaaaagcttgaaaaagagattatgctggcgaaacaaaaagtcttatcgggacagttatcagatatacccgattcggtaaacaagatgaataaaatcagagttgaggggcatgataaattcagataaatcagttggttgattcctgcgggacgaatacatacgtcaggaacataactttatggctggaacgtgaaaatcgtgaactgcgccgcagtaacgatatccttcgccaggcttccgcttattttgcgaaggcggagttcgaccgcctctggaaaaaataatgccactgctggataagctgcgtgagcagtacggggtcggaccggtatgcagtgagctgcatattgccccgtcaacgtattaccactgtcagcaacagcgacatcatcctgataaacgcagtgcccgtgctcagcgcgatgactggctgaagagagagatacagcgcgtatacgatgaaaatcatcaggtgtacggtgtgcgtaaagtctggcgccagttgttacgcgaaggtatcagggtggccagatgtacagtggcgcgcctcatggcggttatgggacttgccggtgttctccggggtaaaaagatccgtactaccgtcagccggaaagccgtttccgcaggcgaccgcgtaaaccgtcagttcgtggcagaacgtcctgaccagctgtgggtggctgattttacttacgtcagcacatggcagggcttcgtctatgtggcgttcatcattgatgtgtttgccggatgtatcgtggggtggcgagtctcatcgtctatggaaacgacattcgtgctggatgcactggagcaggcgttgtgggcccgtcggccgtccggcacagtccatcacagtgataaaggttctcagtatgtatcactggcctatacggagcgactaaaagaagcaaaactgctggcatcaacagggagtacaggtgactcgtatgacaacgcgatggcggagagcatcaatggtctttacaaagcggaggtaatacaccgtaagagctggaaaaaccgtgcagaagtggaactggccacactcacgtgggtggactggtataacaatcgacgattgctgggaaggctgggtcatatccctccggcagaagcagaaaaagcttattatgcttccatcagaaacgatgatctggcagcctgagttcacagataaaacactctccaggaaaaccggggcggttcagtgtttgttatccgtatgataacaaacacataaaggagtaaacatttatctggacgatgattacaatgttcacgactgtcagagacacacctctgatacattagaaaaaccaatgtttcccttaaaaatggagcttatatgaataaaatatactctcttaaatacagccatattacaggagggttaatcgctgtttctgaattatccggcagagtatcatcaagagcaactggtaagaaaaaacacaaacgcatacttgcattatgttttttaggcttattacaatcctcatattcttttgcgtcacagatggatatttcaaatttctacatccgtgactatatggattttgcacagaacaagggcatatttcaggctggcgcaacaaatattgaaatagtgaagaaagatggctccaccctgaaactaccggaagtaccatttcctgacttctcaccggttgcaaacaaagggtcaaccacatctattggtggtgcatacagtatcacagccacacacaatacgaaaaaccaccactcagttgcgacgcaaaactgggggaacagcacgtacaaacaaactgactggaatacttcacatcctgattttgcagtatcccgacttgacaagtttgttgttgagacccgaggtgcgactgaaggcgcagatatttcgttatcaaaacagcaggcacttgaacgttacggggttaattataaaggagaaaagaaacttatcgcattcagagccggctctggtgtggtatccgttaaaaaaaatggacgcataactccatttaatgaggtttcttataagccagaaatgttaaatggctctttcgttcacattgatgactggagtggatggctgatattaaccaacaaccagtttgatgagtttaataacattgcctctcagggtgacagcggttcagcactgttcgtctatgataaccaaaagaaaaagtgggttgtcgctggaactgtctgggggatttataattacgccaatggcaaaaaccacgcagcatacagtaaatggaaccagacaaccattgacaacctgaagaacaagtattcttacaacgtggatatgtcaggggctcaggttgcaaccattgaaaatggaaaactgacaggcactggctcagacaccaccgatataaaaaataaggacttaatatttactggcggtggagatatcctcctgaaatcctcttttgataatggtgctggcggtcttgtctttaatgataaaaagacctatcgagtaaacggggatgatttcacctttaaaggtgccggtgttgatacaagaaacggcagcaccgttgagtggaatatccggtatgataataaagacaaccttcacaaaattggtgatggcacattagatgtccgaaaaacccagaacaccaacctgaaaacaggtgagggtcttgtcattcttggagctgaaaaaacattcaataatatctacataaccagtggtgatggaactgtccgactgaatgcagaaaatgcactgtctggcggtgaatacaacggtattttctttgcgaaaaatggcggaactcttgacctgaacggatataatcagtctttcaataaaattgctgcaactgattcaggtgctgtaataaccaatacgtcaaccaaaaaatccattttatccctgaataatactgctgactatatctatcacggtaacataaacgggaatctggacgtacttcagcatcatgagacgaaaaaagagaaccgtcgtcttattcttgatgggggcgtggacacaacaaatgatataagcctgcgtaatacacaactgtccatgcagggacatgccactgaacatgccatttatcgggatggagctttctcttgttcactaccagctcctatgcgctttttgtgtggcagtgattatgttgcaggaatgcaaaatacagaagctgatgctgtaaaacaaaacggaaatgcctataaaaccaacaatgctgtctctgatttatcgcagccagactgggaaaccggaacattcagatttggaacgctacatcttgaaaattccgatttttctgttggtcgtaatgcaaatgtaatcggggacattcaggccagtaaatcaaacattactattggtgacactacagcatatattgatttgcatgctggtaaaaatattaccggtgatggttttggcttccgccagaatattgtgcgtggaaactcacaaggagaaacgctgtttacaggagggatcacagcagaagacagcactatcgttattaaagataaagcaaaagcattattttcaaattatgtatacctgctgaacacaaaagcaaccatagagaacggtgctgatgtgacaactcaaagtggtatgttctccacgagcgatatcagcatctctggtaatctgtccatgacaggcaatcccgacaaagacaataaattcgagccctcaatatatctgaatgatgcttcttatctactgactgacgactccgccagactcgttgccaaaaataaagcatctgtggtgggagatatacactccactaaaagtgcatccatcatgtttggtcatgatgaaagcgacctctcgcagttgtctgacagaacctcaaaagggcttgcacttggtcttttaggtggctttgatgtctcatatcgcggttcagtcaatgccccgtcagcatctgccactatgaacaacacctggtggcaactaaccggagattctgcgctgaaaacactgaaaagtacaaacagcatggtctatttcactgacagcgcaaacaataagaaattccatacgctgacggtcgatgagctggcaaccagcaacagcgcctatgcgatgcgtacaaacctttctgaatcagacaaactggaggtcaaaaaacacttgtctggtgagaacaatattttactcgttgatttccttcagaaaccaacgcctgaaaaacaactgaatattgaactggtaagcgcgccaaaagacaccaatgaaaatgtctttaaagccagtaaacaaaccattggtttcagtgatgtaacgccggtcattacaaccagggaaaccgatgacaaaataacatggtcactgacaggctataacacggtagcaaacaaggaagcaacccggaatgccgccgccctgttctctgttgactataaagcgtttctgaacgaggtcaacaacctgaacaaacgtatgggtgacctgcgtgatatcaacggcgaagccggtgcatgggcacgcatcatgagcggtaccggctctgccagtggtggtttcagtgacaactacacgcacgttcaggtcggggtcgacaaaaaacacgagctggacggactggatttgtttaccggtttcactgtcacacacactgacagcagtgcctccgccgatgttttcagtggtaaaacgaagtctgtgggggctggcctgtatgcttccgccatgtttgattccggtgcctatatcgacctgattggcaagtatgttcaccatgataatgagtacactgcaacctttgccggactcggaacccgtgattacagcacgcattcatggtatgccggtgcagaagcgggctaccgctatcatgtcactgaggatgcctggattgagccacaggctgagctggtttacggttctgtatccggtaaacagtttgcatggaaggaccagggaatgcatctgtccatgaaggacaaggactacaatccgctgattggccgaacgggtgtggatgtgggtaaatccttctctggtaaggactggaaagtgacagcccgtgccggtctgggctaccagttcgacctgctggctaacggcgaaaccgtattgcgggatgcatctggtgaaaaacgcatcaaaggtgaaaaggacagccgtatgctgatgtccgttggcctgaatgcagaaatcagggataacgtccgctttggactggagtttgagaaatccgcctttggtaagtacaacgttgataatgctgtcaacgctaatttccgttactcgttctgatactccgtattcaaaagggcctgcgggccctttacgctcagtgcctgccgccctgatatgtctgagagacatttccgggatgtcagtcgactggtttacttaactgcgatgactaaagctggcagtaatgccggcttttttacggccacatacgtcttcctctcatccggaactgtgatacaaatcctgcatacaggattgaccgccggttcctgcaaatggcacattttcagtaagatagcgaaggttacatttgtcactggttaacataccgatggtaaaaggggcaagcagcgccagcaattcatcagcccgggggccaaaagtgtaggccagaacgccaccagttttcgtgttgtacgcgtaccagagcctgtgctgtcacgctttactgccgataaaactccattgctcatcaagttcgcagatgagtgccatatcagcatgagcgaccggggatgacgttattcttcgtggcgagcgttttttaaagtccgaatgacagtattaatgccgattttcagcgtacgggcagtatcgcgaactccggcaccgttgaaaggcatttcagtgatttggtcttgaactcccggtttacgggcctcgtaacggtaagtgagctgaaacactcgatgacagtcacggcagcgaaatcgatcatgtccttttgggttcttcccgtgacggtaaacctgaacggactggcaacgggggcaatgaaggttaactgtgaccattaaagaaccttaaaagtgactattatacccctaattcaactaattggaggcattaccatgcattagtgcaagcgccttgtggattcttttgctaatggcggaaacatattgtacaatattgcatttatccctcaataaataaatgagttatcagattgcaaaaatctgttatcaaactaattcaaataaaaagagattgatacgaccaacgtacacaaaaattttcgatattcgaactaaataacagctcctaataccgctacactttagctatccagtctgcgcctcagaaatggacgatgccgttgaaggactggtgtatggcaatgagccgctttattatcgaattcggtgaccgcttggacggtcacttcggagaaaaggcatttacacagcatcctaaacaggttcagcataggtgatataccgccttttcattttcttctccattatttataagggaggtgtattattatgcaatattattggttttatccattgtttttagttcatgaatgtttgcaaaaaaaataaatgaacaataattttatgtatttaaaataaattgattttacttctgtaatggtgtcatgattagcagctttttaaactaatatcgactttcaataaataaggacaggtaatggacaacaaaaatatctgaacccgggtgagattcataagttgcacagtgctgtcttcaaagtgccacacccggaacgtaatcactgcctgctccttatggggtatcttcatggtgtccaagcatcagagttattaggtataaaactgtctgatattgatttgcaggccggtaacctgaatatccggcggctctaaacggtttgtcaactcagcccctcggctgaaacaggaggtacagtccattcgtcgctggctgaaacttcgggatgaatgggtagaagagggatatgaatggttatttaacctctatggcaggtctgctacaggtattactgttgttctggggggcactggtgtggttaatatctacgatgcaagagattctcacgatggcccggtccatcagtgcatgcggcgcgatattgtgcgagtatttttcagggggagtggtatccggatgcagaaaattccgctactcgactggttttatgcaataaatcaggatgataatcttctgattttttactgaggcggatatctctcgctgtgtttactgaaattgcggtattctgttttttctgaaaaacagaaaatctgattaaaaagagcatatgcgttaagggaaatttaagttctggttgattaactgataaaaatattaaaaaatccctgttgtcggtaatctccggaccattccgggattacacaataatatcaccatgtgtgatatctatggatcctcactgttgtttacgcgaggatattttcagaatgcttaacagacgattatttttttatgttgaatgcaaggcatcttcccgtactgatgtatcatcatgtcagtcgttgtccggggcttgtgacactctcacctgaaacattttgtgaacagatgaagtggctcgcagataataactggcggacggtaacatctgctgagcttgaatatttttatcaggggggaacgcttccacgaaagagtgtcatgctcacattcgatgatggttatcttgataactggctcagagcatggccggtcctgaaggaatataaccttcatgcacatatttttctcattacggggctgattggtaagggaaacgtacgtagcaggcaggagcaggaatattctcaccgcgactgtgaacggttgattgccgataaccgttcagatgaggtcatgcttcgctggtctgaagtccgggaaatgcgtgattccggactggttgaatttcatgtgcacacccattcacataaacgctgggacaggttgtctgtatcacgtgctgaacagtgccggctcatgaaagaagatattctggtgggaaaacaatgtctgacggaaaagctggggttctgtagttcccatctgtgctggcctgaaggatattataatcgggattatattaatctcgccggtaagcttggtttctcttatttatatacaaccgaaagaagaatgaactgtcctgaaaatggttcattacgcatagggcgtatcagcaccaaagagcgggaacattccggctggctgaaacgacgccttttttattatacaacgccacttttttcttcagtactggctcttcataaggggccaagattaccagataattaatgatgaaaattttattcactgaatcttcgtcagatattgggggccaggagctgcaggcactggcccagatgactgctcttcaaaagcagggacattccgttttacttgcctgcagagaaaaaagtaaaattgctccggaagccagaaaaagagggcatgatgtcacttttattcctttcaggaacagccttcaccttccttccatcctcagacttcgacggattatcggggaatttaaacctgatctggtcatctgccatagtggccatgacagtaatatagcaggactgagccgtctgatatgctgtcaccgcttcagtattgtcagacaaaaaacctacatcacccgtaagaccagaacgttttccctgaattatctgtgtgatttcattgttgtgcctagctcagccatgatggcgcatctgatggcggaaggtgtcaggacaccggtaacggttattccaccgggtttcgactggcccgcattgcataatgaagccatgcgaccgttacccctgcatatccacgcctgggctgcatcagcagacaatgttccgcttatcgttcaggtggggatgctacgtcccgaaaaaggacatgaatttatgctgcgtgtattgtatcagctgaagatggaagggaaatcatttcgctggctcgtggtgggcgccgggcgtgaagaatacgaagcacgtctgcgtcagcagacagaacacctgggaatgagcggagatgtgttaatggcaggtgcccttttcccagcgttaccggtctaccggattgccagtgtggtggtcatgccttcggaaaatgaagcgtttggtatggtactggctgaagcgtcagtctccggcgtgcccgttatcgccagtgagacgggcgggatccctgatgtcattcagaagaatgtgacagggacgctgttacccgtgggggatgtgtctgcatggaccggcgcactgcgcgattttttatcccgaccggaacgcttccggatgatggcagccagcgccagagaagatattgagtaccggtttgatattaacagaacggcacagatcattgtgtctctggctagtcaggctaaggggaaatgcaacagataacggcggatcctcttttcagcccgaattttgttcagcggttttccggtaacggagtaatttatcacattgtttaaatacggggacggtcaatgcatttaaataccggacagaacaggcctactttcagctggagcgcgctgggatgggcaattttttattttggctttttttccactctcctgcaggtcatcatcttcagcagtgggtacagcggaacgaatggaatacgggactcactgttattcagttgtctgtggttgatcccggtgtttctctatcctgatcggataaaaataattgcagctgttgtcggtttcattctctggggcacgtcgctggcagcactttgttattattttctctatggtcatgaattctctcaaagtgttcttttcgttatgtttgaaacgaatgccagagaggctggtgaatatttcagccagtatttcagccttaaactgttgcttatctcgctggtatatactgcggtgtccgtttttctgtggacacgtctgcgtcctgtatatattcctttgccatggcggagaattgtctctttcctgctgctttatgctctgcttctgcatccggttgttctgaaatcgttaatcagacaggagccgctgaatgatactctaggcaaactggcatcccgaatggagcctgctgccccctggcagtttgtatccagttattatcagtaccatcagcaactgaatgcactgacaaccttcctgaatgaaaatagcgcactgccaccactgggtaatctcagggatgaatcaggggagagaccacgcacactggtcctggtgattggtgagtcgacacagcgcgaacgcatgagcttatacgggtatctacgtgaaacgacgccggagctggatgcactgcgtaaaaccgatccgggtcttactgtgtttaataatgtggtggcatcgcgtccgtacaccattgaagcattgcaacaggcccttactttcgccaacgaaaagaatcctgatctgtatctgacgcagccgtcgctgatgaacatgatgaagcaggcaggctataaaacattctggattaccaaccagcagacaatcacagcccgtaacaccatgctcactgtattttcgcgccagacggacaggcagtactacatgaatcagcagcgaacacaaagtgcgcgtgaatatgacactaacgtgctgaagccgttccgggaagtgctgaatgaccctgcaccaaagaaactgatcatcgtgcatctgctgggtacgcacattaagtataaataccgttatccggaaggtcaggggcggtttgatggcattacagggcatattcccactggattaaatgcgaaagagctggaagtgtataacgattacgataatgccaatctgtttaacgatcatgtggtggccagtctgataaaggacttcagagcaactgcgccggacggctttctgctttatttttcagaccatggtgaagaagtatatgatactccgccatataaaacgcagggacggaatgaagataaccccacacgtcccatgtacactgttccgttcctgctgtggacctcggaaaagtggcatgctgcacatccgcgagatttttcgcagtatgttgaccgcaaatacagtctggctgaactgatccacacctggtcagatttggcgggactgacatacgatggttacgatccgacccgttctctggtgaatccgcaattcagggaaaccacccgctggattggaaatccgtataaaaagaatgggctcactgatttcgacactcttccgtatggtgagccatagtattttcttatcttcggttccgttctgaaggcaggaggatgtgttttcctctgctgtccggtggcctccagggatggtaccaccttctgctgtactctgttatcataatgagataagcaggcagataccggtaaatatgaaaaatatcagaactgagtttattccccgctttaaccttacattatgcttcccccgttactggatgacgtggacaggtatcggtattatctgtgtgtttgcaatggtcccccccgcactgagagatccattgttgggaaaattgggcatgctggttgggcgtctggggaaaagcgcacgtcaacgggccttgattaatttatcgctttgttttccggagtacagtgataaagaaaaggagaatatcgttgatgccatgtttgcaacagcctccatggccgttgtgcttatggctgaattagcactgtccgggcctgataaaatttcgcatcgtatacgctggaatggtctggagattgtggagaagatggcacagaacaatgaaaaggtcatttttcttgtgccacatgcctggggagtggatattcccgcaatgctgatggctgcgtcgggcagaaaaatggcagcgatgtttcataaccagagaaatccggtggtggattatgtctggaacagtgttcgtcgtcgtttcggaggaaaactgcacgcacgtaatgacggtattgcctcctttgtccgctcagtccggcagggatactggggatattatcttcctgatcaggatcatggcccggaattcagtgagtttgcagatttttttgcgacgtataaagcaactttaccggttatcggacggctcagcaggatcagtggtgcacggataataccgcttttccctgtttatgacggaaagacccatcatctgactattcatgtcagcccgccacttgctatacgacagaagagtgatgctcatattgcgcgacagataaacgaagtggttgaaaatttcgttcgtccacatcctgagcagtatacgtggatcctcaagttgctgaaaacgcgtaaagaaggggaagaggatccttactgaggcagctttttcaggataatgagcttacccagcaatagtggacacacgctaagtgagtaaactctcagtcagaggtggctcatatgacaaaaaaacagtaccaaccagtaaaaaaccccgtaaatagcattcgcctgaatttcgcagtgaagccctgaagcttgctgaacgcatcggtgttgctgtcgcagctcgtgtgctcagtctgtatgaatcacagcttgtaagcggctcgtcagaactgtattgatatttactgagcggtcagttcaacgtaagcgagtgttatgcgccatggaagcttacccaggaatatgttatcaggcctcagcatggcgaagtgttgcaacgctggaagcagaatgaccgcggtcaacaacttgttttaccgcttcaattttaaaatcttcgggataacgcttaccgctcatgggcacctctctttaagccatttaaaatgactctgaggtgtctgttaaacccgtggcgattcaatctggatatagtggctaagaatacctttatttttttttttttttttggtttttattttttattgagttttgttttgtatattaaatatttgttgttgattcattatcacacaaaagaatgtatcataatgcaattgtttgatgtgttaaacgttataaacatattaattgtcgtgttttgtgcttgcttatcaaaaggatagttagcttgctttttttgcaaaatataataataaaataagttaaaggacgttataagagttaattctttggtcaggatatatttacgaaacaggtgtaaatatgttataaaaataaccaacgactagtgaataagtcgctcctgaaaaaataaaatatagaaatactgttatatccggctgcatgaacactaaaatgaatgagagatggagaacaccgatgaaattaaagtatctgtcatgtacgatccttgcccctctggcgattggggtattttctgcaacagctgctgataataattcagccatttatttcaatacctcccagcctataaatgatctgcagggttcgttggccgcagaggtgaaatttgcacaa

SEQ ID NO: 8 - DNA, 8590 bp, Escherichia coli
gatcctcttcctgcggcggattatacaatgattgatggtaaagacattaagtcgctgaaagagcaggttatggatttgggtatccctgcatctgagctgataaagacagcctgggcttcagcttccacatttcgtgtgactgattatcgtgggggaaataatggtgcccgcatcaggttacagcccgaaattaactgggaagttaatgagcctgaaaaactgaagaaagtactggcatccctgacctcattacagcgtgaatttaacaaaaaacagtctgacggaaagaaagtgtcgttggctgatttaattgttctttcgggtaatgctgcaatcgaagatgcggccagaaaagccggggtggaacttgagattccctttactccgggaagaactgacgcctctcaggagcagacggatgttgcctcattcagtgtactggagccgacagcagatggattcagaaattattactcaaaaagcagaagtcatatatcgccggttgaaagcctcattgataaagccagtcagctggatctcaccgttcctgaaatgacggcattactgggtggtctgcgggtaatggatattaatacaaataattcttcgttgggagtgtttaccgatacccctggtgttctggataacaagttttttgttaatctgctggatatgtcaacacgatggagtaaagcagataaagaagatacatacaatggattcgatcgtaaaacgggagcattaaaatggaaagcatcctctgttgatttaatcttcagttcaaatcctgaattacgtgcggtggcagaagtatatgcctcggatgatgcgagaaataagtttattcatgattttgttaaatcgtggaataaagttatgaatagcgatcggtttgatttaaacaataaatgataaaactgatgagggagggcacctccctcatgaaggagaaattatgcagaaaagcaataaagttataatcagctgtggtatggcattatattttttgtgtggggggattacagtggcagaagaacttgatgaaagcatgcaagttcttgcaaggaatatgagtgtacttcagtcatcaatggataaaaaggagcttcttgaagctcttgacagaatggatgatgctgtagatgagtcaatgaagcgtcttcctgagagcatttcaccggctgatgaagaagggaagaatgactatataaaagaacttcaaaagcttgaaaaagagattatgctggcgaaacaaaaagtcttatcgggacagttatcagatatacccgattcggtaaacaagatgaataaaatcagagttgaggggcatgataaattcagataaatcagttggttgattcctgcgggacgaatacatacgtcaggaacataactttatggctggaacgtgaaaatcgtgaactgcgccgcagtaacgatatccttcgccaggcttccgcttattttgcgaaggcggagttcgaccgcctctggaaaaaataatgccactgctggataagctgcgtgagcagtacggggtcggaccggtatgcagtgagctgcatattgccccgtcaacgtattaccactgtcagcaacagcgacatcatcctgataaacgcagtgcccgtgctcagcgcgatgactggctgaagagagagatacagcgcgtatacgatgaaaatcatcaggtgtacggtgtgcgtaaagtctggcgccagttgttacgcgaaggtatcagggtggccagatgtacagtggcgcgcctcatggcggttatgggacttgccggtgttctccggggtaaaaagatccgtactaccgtcagccggaaagccgtttccgcaggcgaccgcgtaaaccgtcagttcgtggcagaacgtcctgaccagctgtgggtggctgattttacttacgtcagcacatggcagggcttcgtctatgtggcgttcatcattgatgtgtttgccggatgtatcgtggggtggcgagtctcatcgtctatggaaacgacattcgtgctggatgcactggagcaggcgttgtgggcccgtcggccgtccggcacagtccatcacagtgataaaggttctcagtatgtatcactggcctatacggagcgactaaaagaagcaaaactgctggcatcaacagggagtacaggtgactcgtatgacaacgcgatggcggagagcatcaatggtctttacaaagcggaggtaatacaccgtaagagctggaaaaaccgtgcagaagtggaactggccacactcacgtgggtggactggtataacaatcgacgattgctgggaaggctgggtcatatccctccggcagaagcagaaaaagcttattatgcttccatcagaaacgatgatctggcagcctgagttcacagataaaacactctccaggaaaaccggggcggttcagtgtttgttatccgtatgataacaaacacataaaggagtaaacatttatctggacgatgattacaatgttcacgactgtcagagacacacctctgatacattagaaaaaccaatgtttcccttaaaaatggagcttatatgaataaaatatactctcttaaatacagccatattacaggagggttaatcgctgtttctgaattatccggcagagtatcatcaagagcaactggtaagaaaaaacacaaacgcatacttgcattatgttttttaggcttattacaatcctcatattcttttgcgtcacagatggatatttcaaatttctacatccgtgactatatggattttgcacagaacaagggcatatttcaggctggcgcaacaaatattgaaatagtgaagaaagatggctccaccctgaaactaccggaagtaccatttcctgacttctcaccggttgcaaacaaagggtcaaccacatctattggtggtgcatacagtatcacagccacacacaatacgaaaaaccaccactcagttgcgacgcaaaactgggggaacagcacgtacaaacaaactgactggaatacttcacatcctgattttgcagtatcccgacttgacaagtttgttgttgagacccgaggtgcgactgaaggcgcagatatttcgttatcaaaacagcaggcacttgaacgttacggggttaattataaaggagaaaagaaacttatcgcattcagagccggctctggtgtggtatccgttaaaaaaaatggacgcataactccatttaatgaggtttcttataagccagaaatgttaaatggctctttcgttcacattgatgactggagtggatggctgatattaaccaacaaccagtttgatgagtttaataacattgcctctcagggtgacagcggttcagcactgttcgtctatgataaccaaaagaaaaagtgggttgtcgctggaactgtctgggggatttataattacgccaatggcaaaaaccacgcagcatacagtaaatggaaccagacaaccattgacaacctgaagaacaagtattcttacaacgtggatatgtcaggggctcaggttgcaaccattgaaaatggaaaactgacaggcactggctcagacaccaccgatataaaaaataaggacttaatatttactggcggtggagatatcctcctgaaatcctcttttgataatggtgctggcggtcttgtctttaatgataaaaagacctatcgagtaaacggggatgatttcacctttaaaggtgccggtgttgatacaagaaacggcagcaccgttgagtggaatatccggtatgataataaagacaaccttcacaaaattggtgatggcacattagatgtccgaaaaacccagaacaccaacctgaaaacaggtgagggtcttgtcattcttggagctgaaaaaacattcaataatatctacataaccagtggtgatggaactgtccgactgaatgcagaaaatgcactgtctggcggtgaatacaacggtattttctttgcgaaaaatggcggaactcttgacctgaacggatataatcagtctttcaataaaattgctgcaactgattcaggtgctgtaataaccaatacgtcaaccaaaaaatccattttatccctgaataatactgctgactatatctatcacggtaacataaacgggaatctggacgtacttcagcatcatgagacgaaaaaagagaaccgtcgtcttattcttgatgggggcgtggacacaacaaatgatataagcctgcgtaatacacaactgtccatgcagggacatgccactgaacatgccatttatcgggatggagctttctcttgttcactaccagctcctatgcgctttttgtgtggcagtgattatgttgcaggaatgcaaaatacagaagctgatgctgtaaaacaaaacggaaatgcctataaaaccaacaatgctgtctctgatttatcgcagccagactgggaaaccggaacattcagatttggaacgctacatcttgaaaattccgatttttctgttggtcgtaatgcaaatgtaatcggggacattcaggccagtaaatcaaacattactattggtgacactacagcatatattgatttgcatgctggtaaaaatattaccggtgatggttttggcttccgccagaatattgtgcgtggaaactcacaaggagaaacgctgtttacaggagggatcacagcagaagacagcactatcgttattaaagataaagcaaaagcattattttcaaattatgtatacctgctgaacacaaaagcaaccatagagaacggtgctgatgtgacaactcaaagtggtatgttctccacgagcgatatcagcatctctggtaatctgtccatgacaggcaatcccgacaaagacaataaattcgagccctcaatatatctgaatgatgcttcttatctactgactgacgactccgccagactcgttgccaaaaataaagcatctgtggtgggagatatacactccactaaaagtgcatccatcatgtttggtcatgatgaaagcgacctctcgcagttgtctgacagaacctcaaaagggcttgcacttggtcttttaggtggctttgatgtctcatatcgcggttcagtcaatgccccgtcagcatctgccactatgaacaacacctggtggcaactaaccggagattctgcgctgaaaacactgaaaagtacaaacagcatggtctatttcactgacagcgcaaacaataagaaattccatacgctgacggtcgatgagctggcaaccagcaacagcgcctatgcgatgcgtacaaacctttctgaatcagacaaactggaggtcaaaaaacacttgtctggtgagaacaatattttactcgttgatttccttcagaaaccaacgcctgaaaaacaactgaatattgaactggtaagcgcgccaaaagacaccaatgaaaatgtctttaaagccagtaaacaaaccattggtttcagtgatgtaacgccggtcattacaaccagggaaaccgatgacaaaataacatggtcactgacaggctataacacggtagcaaacaaggaagcaacccggaatgccgccgccctgttctctgttgactataaagcgtttctgaacgaggtcaacaacctgaacaaacgtatgggtgacctgcgtgatatcaacggcgaagccggtgcatgggcacgcatcatgagcggtaccggctctgccagtggtggtttcagtgacaactacacgcacgttcaggtcggggtcgacaaaaaacacgagctggacggactggatttgtttaccggtttcactgtcacacacactgacagcagtgcctccgccgatgttttcagtggtaaaacgaagtctgtgggggctggcctgtatgcttccgccatgtttgattccggtgcctatatcgacctgattggcaagtatgttcaccatgataatgagtacactgcaacctttgccggactcggaacccgtgattacagcacgcattcatggtatgccggtgcagaagcgggctaccgctatcatgtcactgaggatgcctggattgagccacaggctgagctggtttacggttctgtatccggtaaacagtttgcatggaaggaccagggaatgcatctgtccatgaaggacaaggactacaatccgctgattggccgaacgggtgtggatgtgggtaaatccttctctggtaaggactggaaagtgacagcccgtgccggtctgggctaccagttcgacctgctggctaacggcgaaaccgtattgcgggatgcatctggtgaaaaacgcatcaaaggtgaaaaggacagccgtatgctgatgtccgttggcctgaatgcagaaatcagggataacgtccgctttggactggagtttgagaaatccgcctttggtaagtacaacgttgataatgctgtcaacgctaatttccgttactcgttctgatactccgtattcaaaagggcctgcgggccctttacgctcagtgcctgccgccctgatatgtctgagagacatttccgggatgtcagtcgactggtttacttaactgcgatgactaaagctggcagtaatgccggcttttttacggccacatacgtcttcctctcatccggaactgtgatacaaatcctgcatacaggattgaccgccggttcctgcaaatggcacattttcagtaagatagcgaaggttacatttgtcactggttaacataccgatggtaaaaggggcaagcagcgccagcaattcatcagcccgggggccaaaagtgtaggccagaacgccaccagttttcgtgttgtacgcgtaccagagcctgtgctgtcacgctttactgccgataaaactccattgctcatcaagttcgcagatgagtgccatatcagcatgagcgaccggggatgacgttattcttcgtggcgagcgttttttaaagtccgaatgacagtattaatgccgattttcagcgtacgggcagtatcgcgaactccggcaccgttgaaaggcatttcagtgatttggtcttgaactcccggtttacgggcctcgtaacggtaagtgagctgaaacactcgatgacagtcacggcagcgaaatcgatcatgtccttttgggttcttcccgtgacggtaaacctgaacggactggcaacgggggcaatgaaggttaactgtgaccattaaagaaccttaaaagtgactattatacccctaattcaactaattggaggcattaccatgcattagtgcaagcgccttgtggattcttttgctaatggcggaaacatattgtacaatattgcatttatccctcaataaataaatgagttatcagattgcaaaaatctgttatcaaactaattcaaataaaaagagattgatacgaccaacgtacacaaaaattttcgatattcgaactaaataacagctcctaataccgctacactttagctatccagtctgcgcctcagaaatggacgatgccgttgaaggactggtgtatggcaatgagccgctttattatcgaattcggtgaccgcttggacggtcacttcggagaaaaggcatttacacagcatcctaaacaggttcagcataggtgatataccgccttttcattttcttctccattatttataagggaggtgtattattatgcaatattattggttttatccattgtttttagttcatgaatgtttgcaaaaaaaataaatgaacaataattttatgtatttaaaataaattgattttacttctgtaatggtgtcatgattagcagctttttaaactaatatcgactttcaataaataaggacaggtaatggacaacaaaaatatctgaacccgggtgagattcataagttgcacagtgctgtcttcaaagtgccacacccggaacgtaatcactgcctgctccttatggggtatcttcatggtgtccaagcatcagagttattaggtataaaactgtctgatattgatttgcaggccggtaacctgaatatccggcggctctaaacggtttgtcaactcagcccctcggctgaaacaggaggtacagtccattcgtcgctggctgaaacttcgggatgaatgggtagaagagggatatgaatggttatttaacctctatggcaggtctgctacaggtattactgttgttctggggggcactggtgtggttaatatctacgatgcaagagattctcacgatggcccggtccatcagtgcatgcggcgcgatattgtgcgagtatttttcagggggagtggtatccggatgcagaaaattccgctactcgactggttttatgcaataaatcaggatgataatcttctgattttttactgaggcggatatctctcgctgtgtttactgaaattgcggtattctgttttttctgaaaaacagaaaatctgattaaaaagagcatatgcgttaagggaaatttaagttctggttgattaactgataaaaatattaaaaaatccctgttgtcggtaatctccggaccattccgggattacacaataatatcaccatgtgtgatatctatg

SEQ ID NO: 9 - DNA, 92077 bp, Escherichia coli
atggcagagcaaaaacgaccggtactgacactgaagcggaaaacggaaggagagacgcctgtccgcagccggaaaaccatcatcaatgtcaccacgccaccaaaatggaaggtgaaaaagcagaagctggccgagaaagcagcccgggaagcggagctggcggcaaaaaaagcgcaggccagacaggcgctgtccatttatctgaacctgcccacgcaggatgaggccgtgaacaccctgaaaccctggtggccgggattatttgacggtgacacgccccggcttctggcctgcggtatccgggacgtgttactggaagacgtggcgcagcggaatatcccgctctcgcataaaaagctgcgcagggcgctgaaggccatcacccgttcagaaagctatctgtgtgccatgaaagccggtgcctgccggtatgacacggaagggtatgtgacggagcatatttctcaggaggaggaagcgtatgcggcagcgcgtctggataaaatccgccgccagaaccggataaaggcagaacttcaggccgtgcttgatgagaaataaaaaaagcctccctcagagagaggaggcagggaaataaggcttaaaaggaaataacttccgtacccgaaaggaagccaattcagtagattatttaacaccataatactgacgggttaaagaggagtgataaagatgaatggattcagaaacagttcacggaacggtcaggtctggcgttaccagcgtgccggaagccgggccgttattctggaagtcagtggacgctggatggaagcggcagaagcatggcgacgggctgccggtgttgcaccccggactgactggcagcagtttgcccgaaaaagggctgaacactgccaccggcgctgccgaggaagggggtaacgaaaaaagcagccttcattactccagggattcagaaggctgaataatgcatgagatttgctttttttaatatccggtcgggcagtatgaccggccagttctgagtagcacagagttttttccgtattaagtcgtgattttatattttgtgattaatttcacaaaataaggtgttattaagtgtgtgctgcaatattcaggatgcctgaaatacaggtgctatttatctgatacggagaataacatgaggaaatatattccactggtattatttatcttttcatggccggtattgtgtgcagatattcatggacgggttgttcgtgtactggacggtgataccatcgaggtcatggactcacggaaggcggtgcggatcaggctggtaaatattgatgcgccggaaaagaaacaggattatggccggtggtcgacagacatgatgaaatcactggttgcaggaaaaacggttaccgtcacatattttcagcgagatcgttatggtcgtatgctcgggcaggtttatgcaccagacggaatgaatgttaatcagtttatggtccgggccggggccgcctgggtatatgagcagtacaacacagatcccgtgctgcctgtccttcagaacgaagccagacaacaaaaacgtgggctctggtcagatgctgatccggttcccccctggatatggagacaccgtaaataaagcgatggcaatcttatcattcatctgttctcagcgggaataaaaatggaaaaaacaaaacaggaatggctgtatcaattacggcgatgttcatcagtcaatacgctggaaaaaattattcataaaaacagagacagtttatcgaccagtgaacgtgaatcatttaattcagcagcagaccaccggttagcagaattaatcaccggaaagttatatgacaggataccaaaagaaatatggaaatatgtaaggtaatagttcagcataattaattaccaggagcagataaacaatgaagctgattatttttattctcattgttctgattattgcagcgttacttatccggattatcctcagaagtgtaaatcagcattctcctttgctgatgcaattgcatgcggcaggtatacggaccggtgatgcagagcgaatactgtccggcggtgaatatgatgccagccatttacgacctgaacgcagacgccgggatattcttctggaagaggttctgaggcaggctggtattccgttgctcagaagccacgatgccagaaaactgctgcagatgaccggagaatggctgaatacaacaggggctgctcagcagtcaccggaacatcgtagctgacgccttcgcgttgctcagttgtccaaccccggaaacgggaaaaagcaagttttccccgctcccggcgtttccataactgaaaaccatactatttcacagtttaaatcacattaaacgacagtaatccccgttgatttgtgcgccaacacagatcttcgtcacaattctcaagtcgctgatttcaaaaaactgtagtatcctctgcgaaacgatccctgtttaagtattgaggaggcgagatgtcgcagacagaaaatgcagtgacttcctcatctggcgcaaaacgagcatacagaaaggggaatccgctttctgatgcagagaaacaaagattatcagtggcccgtaaaagagcttcgttcaaggaagtaaaagtatttcttgaaccaaagtataaggccatgctcatgcaaatgtgtcatgaagatggcctgactcaggctgaagttctgaccgcactgataaaaagtgaagcgcaaaaacgatgtgtgtgatgatgggcttacattcttgagtgttcagaagattagtgctagattactgatcgtttaaggaattttgtggctggccacgccgtaaggtggcagggaactggttctgatgtggatttacaggagccagaaaagcaaaaaccccgataatcttcagaaagtttggcgactgagaagattaccggggcccacttaaaccgtatagccaacaattcagctatgcggggagtatagttatatgctcggaaaagttcaagacttctttctgtgctcgctccttctgcgcattgtaagtgcaggatggtgtgactgatcttcaacaaacgtattaccgccaggtaaagaacccgaatccggtgttcacaccccgtgaaggtgccggaacgctgaagttctgcgaaaaactgatggaaaaggcggtgggcttcacctcccgttttgatttcgccattcatgtggcacatgcccgttcgaagggactgcgtcggcgcatgccaccggtactgcgtcgccgggctattgatgcgctgctgcaggggctgtgttttcactatgacccgctggccaaccgtgtccagtgctccatcaccacactggccattgagtgcggactggcgacggagtctgctgccggaaaactctccatcacccgtgccacccgggccctgacgttcctgtcagagctgggactgattacctaccagacggaatatgacccgcttatcgggtgctacattccgaccgacatcacgttcacaccggctctgtttgctgcccttgatgtgtctgaggatgcagtggcagctgcgcgccgcagccgtgttgaatgggaaaacaggctgcgcaaaaagcaggggctggataccctgggtatggatgaactgatagcgaaagcctggcgttttgtgcgtgagcgtttccgcagttaccagacagagcttaagtcacggggaataaagcgtgcccgtgcgcgtcgtgatgcgggcagggaacgtcaggatatcgtcaccctggtgaaacggcagctgacgcgtgaaatctcggaagggcgcttcactgctaatcgtgaggcggtaaaacgcgaagtggagcgtcgtgtgaaggagcgcatgattctgtcacgtaaccgcaattacagccggctggccacagcttccccctgaaagtgacctcctcagaataatccggcacgcgccggaggcattcgcacgcctgaagcccgccggtgcacaaaaaatcagcaccacatcccaaaaacaacctcatcatctaccttctggtgcatccggtcccccctgttttgatacaaaacacgtctcacagacgggcaattttgtttatccacattaaactgcaagggatttctctgtaagattacaaccgttcatgtcataaagcaccagccgccaggcttacagggtgcaatgtatcttttaaacacccgtttatatctcctttaaactacttaattacattcatttaaaaaaaagacttattcactgcctgtcctgtggacagacagatatgcacctcccaccgcaagcggcgggccccaaccggagccactttagttacaacacacaaaaacaacctccagaaaaaccccggtcccgcgcagaactgaaaccacaaagcccctccctcataactgaaaaacggccccgccccggcccaaagggccggaacagagtcgcttttaattatgaatgttgtaactaagcatcatcatcgctgtcagtcttctggctgaacgttctcagtacacgctcgtaagcggccctgagggctcgctaacgcggagatacgccccgacttcgggtaaaccctcgtcgggaccactccgaccgcgcacataaactctctcatggctgaaagcgggtatggtctggcagggctggggggggggtaaggtgaaatccatcaatcagtaccggcttacgccgggcttcggcggttttacacctgtgctacatgtaacctccgtataccgccttacatgcgctgacgcgcattatttgccttgttccgtctgaaagtaatcactatgattaaatatgattaacgactaatcggatatgcaaatgaaaaacaataccgcacaagcaacaaaagtcattaccgcgcatgtgccattacctatggctgataaagtcgaccagatggccgccagactggaacgctcccggggttgggttatcaaacaggcgctttctgcatggcttgcccaggaggaggagcgtaatcgcctgacgctggaagccctggacgatgtgacatccggacaggttattgaccatcaggctgtacaggcctgggcggacagcctcagtactgacaatccgttaccggtgccacgctgatggaactgaagtggagcagtaaagcgctttctgatttggcgcggttatatgattttctggtgctagccagtaaacctgctgccgccagaacggtacagtccctgacacaggcaccggtcattctgttaactcatccacgtatgggggaacagttatttcagtttgaacccagggaggtcagacggatttttgctggcgagtacgaaatccgttacgaacttaatggccagactatttatgtattgcgcctgtggcacacacgagaaaacaggtagattgtgtgtggggacaacttaacatagcctgcagatattaattctggaacattattatcaggccagatatttaaataatcttgtaggagataaaatgaattacgatgaaataacgaaaattaccgctgaacgtattagcgactacatgactgaagcagttaatacagactctatagccgttgcggaaatgtttcataacgcagcatggggagtgcgaacattgtggtttgaactcgtcacaaaaatagatatagatatacataaaaagaacagatatgcgagttatgatcttgatcgataggaatttaaatcccaaaaagattaaaaaaacacccaaaaacggatgtttattcaacactgcctgcgtgccatgagtgcaccgccgtcaattaaatggatctatttcatcctgaccagcatagtgctccagacggctcatcggcaccggcggttttttcaggtaagagccgaagtacaccgccacatgtgtggcgttatccatcacccgggatacgttgacattccagccccgccggtaatgactgtccaggaagcgattcctgtcccgtttactgcttccttctgctgccagcgcatccggtatcaccaggtccggtgaggtgtactggcaatagcggacactaccatttgttctttttttaagcagccatctgatgatatttttccctgaaggctgccggggagatattccccagacgagagtgacgacgctgacgattgtagaaaatctcaatgtattcccgtattactgagatggcttcatcccggttattaaaacgatagtggctcaggctctcatttttcagcgttccccagaagctttccatcggagcgttgtcgtaacagttacctttacgcgacattgatgttttcagaccaaactgctcctgtatgacccggtaatcgtatgcgcagtactgtgaacctcgatcagagtggtggattagcccggcaggtgggcgctggctcctgagcgccataaacagggctttacctgtcagctcttttgtcatgcgctctcccatggcgtagccgacaatttcgcacgtataaacatctttgatgccagcgaggtacaaccatccctcctgtgtggcaacatacgtcaggtccgccacccagacctgatttggtgctgcaggagcgaacgtctggttcagcagatttggcgcaactggcagattgtggttcgagttcgtagtcgcacatctgcctggcggcagatttcctgtatcacatccgcagcaatgcggctcatctctgccagtaaccaccggttgtggaacaccagggaccagtactggcagggaagtgtgaacacaatatgctgccacggacagtcgggaaccagactcagcagatactgtatccactgtgcgccagccttcactccgcagtgcgggcaggagcgacttttacaccggaagcagaccttttttatgtggctgcagtccggagatgaacagcaccactgtgtgtaccccatcagcgtggtcccgcaggccatgatttttgtcacagactcaatgactaccggacgcactgaaccttccggttgtttctccagccagttaagccagcggtttccctgctgaaaaatgtcggcaaaacggggaagcatcagaagggcgggggaactccgtccggccagtgaaccgtgccacactccgggcagtacatgccgccggcgctgataccggcaagaatggtcgcaaactcccgctccgtgcagcgggctatttcaggatacccttcgtcatcaacacgtacaaaccagaagaccagctttttgtttctgacatccacaaagaagggaatattcaggtctgcgcagcactcaacggcatcgtcagttgcggcttggaaccccttagtattttttgtctgtagtatctatcccagcaataggtatatcctgttgcatcaataaagttgacttttgtatacaacatgcgaatttcccttaatccggagctattcgtatgataaaaaaaactcttcctgttctgattcttctggcgctatcggggagcttttctaccgctgtagccgctgataaaaaagagactcaaaatttctactatccagaaacactggatttaactcctctgagattacacagccctgaatcaaatccctggggggctgattttgattatgccaccagatttcaacagctggatatggaggctctgaaaaaagatatcaaagatttgctgacaacttcccaggattggtggcctgcggattatggtcattatggtcctttctttattcgtatggcttggcacggtgccggaacatacaggacatatgatggccggggaggcgccagtggtggtcagcaacgttttgaaccgctgaacagctggccggataacgttaatctggataaagcccgtcgattgctgtggccagtcaagaaaaaatacggctccagtatttcctggggagacctgatggtcctgactggtaatgttgcccttgaatccatgggatttaaaacgctgggatttgctggcggaagagaagatgactgggagtcggacctggtatactgggggcctgacaacaagcctcttgcagataaccgggataaaaacgggaaacttcagaaacctcttgccgccacgcagatgggacttatttatgtcaatcctgaaggccccggtggaaaaccagatcctctggcttccgcgaaagatatcagggaagctttttcacgtatggccatggatgatgaggagactgtggccctgatcgcgggagggcatacatttggtaaagcacatggtgcagcgtctcctgaaaaatgtattggcgcagggcctgatggtgcacctgtggaggagcagggactgggatggaaaaataaatgtggtacaggaaacggcaaatataccatcaccagtggcctggaaggagcctggtcgacatcgccaacccagttcacaatgcagtatctgaagaatttatataaatatgaatgggagctgcacaagagtcctgccggtgcttatcagtggaagcctaaaaaagcggcaaatatagttcaggacgcgcatgatccgtctgtcctgcatccgttgatgatgtttacgacggatattgctcttaaagttgatcctgaatataagaaaataaccacccgtttcctgaatgatccaaaagcttttgagcaggcattcgcaagagcatggtttaaactgacccaccgggatatgggaccggcagcccgatatcttggtaatgaagttcctgcagaatcatttatctggcaggatcctcttcctgcggcggattatacaatgattgatggtaaagacattaagtcgctgaaagagcaggttatggatttgggtatccctgcatctgagctgataaagacagcctgggcttcagcttccacatttcgtgtgactgattatcgtgggggaaataatggtgcccgcatcaggttacagcccgaaattaactgggaagttaatgagcctgaaaaactgaagaaagtactggcatccctgacctcattacagcgtgaatttaacaaaaaacagtctgacggaaagaaagtgtcgttggctgatttaattgttctttcgggtaatgctgcaatcgaagatgcggccagaaaagccggggtggaacttgagattccctttactccgggaagaactgacgcctctcaggagcagacggatgttgcctcattcagtgtactggagccgacagcagatggattcagaaattattactcaaaaagcagaagtcatatatcgccggttgaaagcctcattgataaagccagtcagctggatctcaccgttcctgaaatgacggcattactgggtggtctgcgggtaatggatattaatacaaataattcttcgttgggagtgtttaccgatacccctggtgttctggataacaagttttttgttaatctgctggatatgtcaacacgatggagtaaagcagataaagaagatacatacaatggattcgatcgtaaaacgggagcattaaaatggaaagcatcctctgttgatttaatcttcagttcaaatcctgaattacgtgcggtggcagaagtatatgcctcggatgatgcgagaaataagtttattcatgattttgttaaatcgtggaataaagttatgaatagcgatcggtttgatttaaacaataaatgataaaactgatgagggagggcacctccctcatgaaggagaaattatgcagaaaagcaataaagttataatcagctgtggtatggcattatattttttgtgtggggggattacagtggcagaagaacttgatgaaagcatgcaagttcttgcaaggaatatgagtgtacttcagtcatcaatggataaaaaggagcttcttgaagctcttgacagaatggatgatgctgtagatgagtcaatgaagcgtcttcctgagagcatttcaccggctgatgaagaagggaagaatgactatataaaagaacttcaaaagcttgaaaaagagattatgctggcgaaacaaaaagtcttatcgggacagttatcagatatacccgattcggtaaacaagatgaataaaatcagagttgaggggcatgataaattcagataaatcagttggttgattcctgcgggacgaatacatacgtcaggaacataactttatggctggaacgtgaaaatcgtgaactgcgccgcagtaacgatatccttcgccaggcttccgcttattttgcgaaggcggagttcgaccgcctctggaaaaaataatgccactgctggataagctgcgtgagcagtacggggtcggaccggtatgcagtgagctgcatattgccccgtcaacgtattaccactgtcagcaacagcgacatcatcctgataaacgcagtgcccgtgctcagcgcgatgactggctgaagagagagatacagcgcgtatacgatgaaaatcatcaggtgtacggtgtgcgtaaagtctggcgccagttgttacgcgaaggtatcagggtggccagatgtacagtggcgcgcctcatggcggttatgggacttgccggtgttctccggggtaaaaagatccgtactaccgtcagccggaaagccgtttccgcaggcgaccgcgtaaaccgtcagttcgtggcagaacgtcctgaccagctgtgggtggctgattttacttacgtcagcacatggcagggcttcgtctatgtggcgttcatcattgatgtgtttgccggatgtatcgtggggtggcgagtctcatcgtctatggaaacgacattcgtgctggatgcactggagcaggcgttgtgggcccgtcggccgtccggcacagtccatcacagtgataaaggttctcagtatgtatcactggcctatacggagcgactaaaagaagcaaaactgctggcatcaacagggagtacaggtgactcgtatgacaacgcgatggcggagagcatcaatggtctttacaaagcggaggtaatacaccgtaagagctggaaaaaccgtgcagaagtggaactggccacactcacgtgggtggactggtataacaatcgacgattgctgggaaggctgggtcatatccctccggcagaagcagaaaaagcttattatgcttccatcagaaacgatgatctggcagcctgagttcacagataaaacactctccaggaaaaccggggcggttcagtgtttgttatccgtatgataacaaacacataaaggagtaaacatttatctggacgatgattacaatgttcacgactgtcagagacacacctctgatacattagaaaaaccaatgtttcccttaaaaatggagcttatatgaataaaatatactctcttaaatacagccatattacaggagggttaatcgctgtttctgaattatccggcagagtatcatcaagagcaactggtaagaaaaaacacaaacgcatacttgcattatgttttttaggcttattacaatcctcatattcttttgcgtcacagatggatatttcaaatttctacatccgtgactatatggattttgcacagaacaagggcatatttcaggctggcgcaacaaatattgaaatagtgaagaaagatggctccaccctgaaactaccggaagtaccatttcctgacttctcaccggttgcaaacaaagggtcaaccacatctattggtggtgcatacagtatcacagccacacacaatacgaaaaaccaccactcagttgcgacgcaaaactgggggaacagcacgtacaaacaaactgactggaatacttcacatcctgattttgcagtatcccgacttgacaagtttgttgttgagacccgaggtgcgactgaaggcgcagatatttcgttatcaaaacagcaggcacttgaacgttacggggttaattataaaggagaaaagaaacttatcgcattcagagccggctctggtgtggtatccgttaaaaaaaatggacgcataactccatttaatgaggtttcttataagccagaaatgttaaatggctctttcgttcacattgatgactggagtggatggctgatattaaccaacaaccagtttgatgagtttaataacattgcctctcagggtgacagcggttcagcactgttcgtctatgataaccaaaagaaaaagtgggttgtcgctggaactgtctgggggatttataattacgccaatggcaaaaaccacgcagcatacagtaaatggaaccagacaaccattgacaacctgaagaacaagtattcttacaacgtggatatgtcaggggctcaggttgcaaccattgaaaatggaaaactgacaggcactggctcagacaccaccgatataaaaaataaggacttaatatttactggcggtggagatatcctcctgaaatcctcttttgataatggtgctggcggtcttgtctttaatgataaaaagacctatcgagtaaacggggatgatttcacctttaaaggtgccggtgttgatacaagaaacggcagcaccgttgagtggaatatccggtatgataataaagacaaccttcacaaaattggtgatggcacattagatgtccgaaaaacccagaacaccaacctgaaaacaggtgagggtcttgtcattcttggagctgaaaaaacattcaataatatctacataaccagtggtgatggaactgtccgactgaatgcagaaaatgcactgtctggcggtgaatacaacggtattttctttgcgaaaaatggcggaactcttgacctgaacggatataatcagtctttcaataaaattgctgcaactgattcaggtgctgtaataaccaatacgtcaaccaaaaaatccattttatccctgaataatactgctgactatatctatcacggtaacataaacgggaatctggacgtacttcagcatcatgagacgaaaaaagagaaccgtcgtcttattcttgatgggggcgtggacacaacaaatgatataagcctgcgtaatacacaactgtccatgcagggacatgccactgaacatgccatttatcgggatggagctttctcttgttcactaccagctcctatgcgctttttgtgtggcagtgattatgttgcaggaatgcaaaatacagaagctgatgctgtaaaacaaaacggaaatgcctataaaaccaacaatgctgtctctgatttatcgcagccagactgggaaaccggaacattcagatttggaacgctacatcttgaaaattccgatttttctgttggtcgtaatgcaaatgtaatcggggacattcaggccagtaaatcaaacattactattggtgacactacagcatatattgatttgcatgctggtaaaaatattaccggtgatggttttggcttccgccagaatattgtgcgtggaaactcacaaggagaaacgctgtttacaggagggatcacagcagaagacagcactatcgttattaaagataaagcaaaagcattattttcaaattatgtatacctgctgaacacaaaagcaaccatagagaacggtgctgatgtgacaactcaaagtggtatgttctccacgagcgatatcagcatctctggtaatctgtccatgacaggcaatcccgacaaagacaataaattcgagccctcaatatatctgaatgatgcttcttatctactgactgacgactccgccagactcgttgccaaaaataaagcatctgtggtgggagatatacactccactaaaagtgcatccatcatgtttggtcatgatgaaagcgacctctcgcagttgtctgacagaacctcaaaagggcttgcacttggtcttttaggtggctttgatgtctcatatcgcggttcagtcaatgccccgtcagcatctgccactatgaacaacacctggtggcaactaaccggagattctgcgctgaaaacactgaaaagtacaaacagcatggtctatttcactgacagcgcaaacaataagaaattccatacgctgacggtcgatgagctggcaaccagcaacagcgcctatgcgatgcgtacaaacctttctgaatcagacaaactggaggtcaaaaaacacttgtctggtgagaacaatattttactcgttgatttccttcagaaaccaacgcctgaaaaacaactgaatattgaactggtaagcgcgccaaaagacaccaatgaaaatgtctttaaagccagtaaacaaaccattggtttcagtgatgtaacgccggtcattacaaccagggaaaccgatgacaaaataacatggtcactgacaggctataacacggtagcaaacaaggaagcaacccggaatgccgccgccctgttctctgttgactataaagcgtttctgaacgaggtcaacaacctgaacaaacgtatgggtgacctgcgtgatatcaacggcgaagccggtgcatgggcacgcatcatgagcggtaccggctctgccagtggtggtttcagtgacaactacacgcacgttcaggtcggggtcgacaaaaaacacgagctggacggactggatttgtttaccggtttcactgtcacacacactgacagcagtgcctccgccgatgttttcagtggtaaaacgaagtctgtgggggctggcctgtatgcttccgccatgtttgattccggtgcctatatcgacctgattggcaagtatgttcaccatgataatgagtacactgcaacctttgccggactcggaacccgtgattacagcacgcattcatggtatgccggtgcagaagcgggctaccgctatcatgtcactgaggatgcctggattgagccacaggctgagctggtttacggttctgtatccggtaaacagtttgcatggaaggaccagggaatgcatctgtccatgaaggacaaggactacaatccgctgattggccgaacgggtgtggatgtgggtaaatccttctctggtaaggactggaaagtgacagcccgtgccggtctgggctaccagttcgacctgctggctaacggcgaaaccgtattgcgggatgcatctggtgaaaaacgcatcaaaggtgaaaaggacagccgtatgctgatgtccgttggcctgaatgcagaaatcagggataacgtccgctttggactggagtttgagaaatccgcctttggtaagtacaacgttgataatgctgtcaacgctaatttccgttactcgttctgatactccgtattcaaaagggcctgcgggccctttacgctcagtgcctgccgccctgatatgtctgagagacatttccgggatgtcagtcgactggtttacttaactgcgatgactaaagctggcagtaatgccggcttttttacggccacatacgtcttcctctcatccggaactgtgatacaaatcctgcatacaggattgaccgccggttcctgcaaatggcacattttcagtaagatagcgaaggttacatttgtcactggttaacataccgatggtaaaaggggcaagcagcgccagcaattcatcagcccgggggccaaaagtgtaggccagaacgccaccagttttcgtgttgtacgcgtaccagagcctgtgctgtcacgctttactgccgataaaactccattgctcatcaagttcgcagatgagtgccatatcagcatgagcgaccggggatgacgttattcttcgtggcgagcgttttttaaagtccgaatgacagtattaatgccgattttcagcgtacgggcagtatcgcgaactccggcaccgttgaaaggcatttcagtgatttggtcttgaactcccggtttacgggcctcgtaacggtaagtgagctgaaacactcgatgacagtcacggcagcgaaatcgatcatgtccttttgggttcttcccgtgacggtaaacctgaacggactggcaacgggggcaatgaaggttaactgtgaccattaaagaaccttaaaagtgactattatacccctaattcaactaattggaggcattaccatgcattagtgcaagcgccttgtggattcttttgctaatggcggaaacatattgtacaatattgcatttatccctcaataaataaatgagttatcagattgcaaaaatctgttatcaaactaattcaaataaaaagagattgatacgaccaacgtacacaaaaattttcgatattcgaactaaataacagctcctaataccgctacactttagctatccagtctgcgcctcagaaatggacgatgccgttgaaggactggtgtatggcaatgagccgctttattatcgaattcggtgaccgcttggacggtcacttcggagaaaaggcatttacacagcatcctaaacaggttcagcataggtgatataccgccttttcattttcttctccattatttataagggaggtgtattattatgcaatattattggttttatccattgtttttagttcatgaatgtttgcaaaaaaaataaatgaacaataattttatgtatttaaaataaattgattttacttctgtaatggtgtcatgattagcagctttttaaactaatatcgactttcaataaataaggacaggtaatggacaacaaaaatatctgaacccgggtgagattcataagttgcacagtgctgtcttcaaagtgccacacccggaacgtaatcactgcctgctccttatggggtatcttcatggtgtccaagcatcagagttattaggtataaaactgtctgatattgatttgcaggccggtaacctgaatatccggcggctctaaacggtttgtcaactcagcccctcggctgaaacaggaggtacagtccattcgtcgctggctgaaacttcgggatgaatgggtagaagagggatatgaatggttatttaacctctatggcaggtctgctacaggtattactgttgttctggggggcactggtgtggttaatatctacgatgcaagagattctcacgatggcccggtccatcagtgcatgcggcgcgatattgtgcgagtatttttcagggggagtggtatccggatgcagaaaattccgctactcgactggttttatgcaataaatcaggatgataatcttctgattttttactgaggcggatatctctcgctgtgtttactgaaattgcggtattctgttttttctgaaaaacagaaaatctgattaaaaagagcatatgcgttaagggaaatttaagttctggttgattaactgataaaaatattaaaaaatccctgttgtcggtaatctccggaccattccgggattacacaataatatcaccatgtgtgatatctatggatcctcactgttgtttacgcgaggatattttcagaatgcttaacagacgattatttttttatgttgaatgcaaggcatcttcccgtactgatgtatcatcatgtcagtcgttgtccggggcttgtgacactctcacctgaaacattttgtgaacagatgaagtggctcgcagataataactggcggacggtaacatctgctgagcttgaatatttttatcaggggggaacgcttccacgaaagagtgtcatgctcacattcgatgatggttatcttgataactggctcagagcatggccggtcctgaaggaatataaccttcatgcacatatttttctcattacggggctgattggtaagggaaacgtacgtagcaggcaggagcaggaatattctcaccgcgactgtgaacggttgattgccgataaccgttcagatgaggtcatgcttcgctggtctgaagtccgggaaatgcgtgattccggactggttgaatttcatgtgcacacccattcacataaacgctgggacaggttgtctgtatcacgtgctgaacagtgccggctcatgaaagaagatattctggtgggaaaacaatgtctgacggaaaagctggggttctgtagttcccatctgtgctggcctgaaggatattataatcgggattatattaatctcgccggtaagcttggtttctcttatttatatacaaccgaaagaagaatgaactgtcctgaaaatggttcattacgcatagggcgtatcagcaccaaagagcgggaacattccggctggctgaaacgacgccttttttattatacaacgccacttttttcttcagtactggctcttcataaggggccaagattaccagataattaatgatgaaaattttattcactgaatcttcgtcagatattgggggccaggagctgcaggcactggcccagatgactgctcttcaaaagcagggacattccgttttacttgcctgcagagaaaaaagtaaaattgctccggaagccagaaaaagagggcatgatgtcacttttattcctttcaggaacagccttcaccttccttccatcctcagacttcgacggattatcggggaatttaaacctgatctggtcatctgccatagtggccatgacagtaatatagcaggactgagccgtctgatatgctgtcaccgcttcagtattgtcagacaaaaaacctacatcacccgtaagaccagaacgttttccctgaattatctgtgtgatttcattgttgtgcctagctcagccatgatggcgcatctgatggcggaaggtgtcaggacaccggtaacggttattccaccgggtttcgactggcccgcattgcataatgaagccatgcgaccgttacccctgcatatccacgcctgggctgcatcagcagacaatgttccgcttatcgttcaggtggggatgctacgtcccgaaaaaggacatgaatttatgctgcgtgtattgtatcagctgaagatggaagggaaatcatttcgctggctcgtggtgggcgccgggcgtgaagaatacgaagcacgtctgcgtcagcagacagaacacctgggaatgagcggagatgtgttaatggcaggtgcccttttcccagcgttaccggtctaccggattgccagtgtggtggtcatgccttcggaaaatgaagcgtttggtatggtactggctgaagcgtcagtctccggcgtgcccgttatcgccagtgagacgggcgggatccctgatgtcattcagaagaatgtgacagggacgctgttacccgtgggggatgtgtctgcatggaccggcgcactgcgcgattttttatcccgaccggaacgcttccggatgatggcagccagcgccagagaagatattgagtaccggtttgatattaacagaacggcacagatcattgtgtctctggctagtcaggctaaggggaaatgcaacagataacggcggatcctcttttcagcccgaattttgttcagcggttttccggtaacggagtaatttatcacattgtttaaatacggggacggtcaatgcatttaaataccggacagaacaggcctactttcagctggagcgcgctgggatgggcaattttttattttggctttttttccactctcctgcaggtcatcatcttcagcagtgggtacagcggaacgaatggaatacgggactcactgttattcagttgtctgtggttgatcccggtgtttctctatcctgatcggataaaaataattgcagctgttgtcggtttcattctctggggcacgtcgctggcagcactttgttattattttctctatggtcatgaattctctcaaagtgttcttttcgttatgtttgaaacgaatgccagagaggctggtgaatatttcagccagtatttcagccttaaactgttgcttatctcgctggtatatactgcggtgtccgtttttctgtggacacgtctgcgtcctgtatatattcctttgccatggcggagaattgtctctttcctgctgctttatgctctgcttctgcatccggttgttctgaaatcgttaatcagacaggagccgctgaatgatactctaggcaaactggcatcccgaatggagcctgctgccccctggcagtttgtatccagttattatcagtaccatcagcaactgaatgcactgacaaccttcctgaatgaaaatagcgcactgccaccactgggtaatctcagggatgaatcaggggagagaccacgcacactggtcctggtgattggtgagtcgacacagcgcgaacgcatgagcttatacgggtatctacgtgaaacgacgccggagctggatgcactgcgtaaaaccgatccgggtcttactgtgtttaataatgtggtggcatcgcgtccgtacaccattgaagcattgcaacaggcccttactttcgccaacgaaaagaatcctgatctgtatctgacgcagccgtcgctgatgaacatgatgaagcaggcaggctataaaacattctggattaccaaccagcagacaatcacagcccgtaacaccatgctcactgtattttcgcgccagacggacaggcagtactacatgaatcagcagcgaacacaaagtgcgcgtgaatatgacactaacgtgctgaagccgttccgggaagtgctgaatgaccctgcaccaaagaaactgatcatcgtgcatctgctgggtacgcacattaagtataaataccgttatccggaaggtcaggggcggtttgatggcattacagggcatattcccactggattaaatgcgaaagagctggaagtgtataacgattacgataatgccaatctgtttaacgatcatgtggtggccagtctgataaaggacttcagagcaactgcgccggacggctttctgctttatttttcagaccatggtgaagaagtatatgatactccgccatataaaacgcagggacggaatgaagataaccccacacgtcccatgtacactgttccgttcctgctgtggacctcggaaaagtggcatgctgcacatccgcgagatttttcgcagtatgttgaccgcaaatacagtctggctgaactgatccacacctggtcagatttggcgggactgacatacgatggttacgatccgacccgttctctggtgaatccgcaattcagggaaaccacccgctggattggaaatccgtataaaaagaatgggctcactgatttcgacactcttccgtatggtgagccatagtattttcttatcttcggttccgttctgaaggcaggaggatgtgttttcctctgctgtccggtggcctccagggatggtaccaccttctgctgtactctgttatcataatgagataagcaggcagataccggtaaatatgaaaaatatcagaactgagtttattccccgctttaaccttacattatgcttcccccgttactggatgacgtggacaggtatcggtattatctgtgtgtttgcaatggtcccccccgcactgagagatccattgttgggaaaattgggcatgctggttgggcgtctggggaaaagcgcacgtcaacgggccttgattaatttatcgctttgttttccggagtacagtgataaagaaaaggagaatatcgttgatgccatgtttgcaacagcctccatggccgttgtgcttatggctgaattagcactgtccgggcctgataaaatttcgcatcgtatacgctggaatggtctggagattgtggagaagatggcacagaacaatgaaaaggtcatttttcttgtgccacatgcctggggagtggatattcccgcaatgctgatggctgcgtcgggcagaaaaatggcagcgatgtttcataaccagagaaatccggtggtggattatgtctggaacagtgttcgtcgtcgtttcggaggaaaactgcacgcacgtaatgacggtattgcctcctttgtccgctcagtccggcagggatactggggatattatcttcctgatcaggatcatggcccggaattcagtgagtttgcagatttttttgcgacgtataaagcaactttaccggttatcggacggctcagcaggatcagtggtgcacggataataccgcttttccctgtttatgacggaaagacccatcatctgactattcatgtcagcccgccacttgctatacgacagaagagtgatgctcatattgcgcgacagataaacgaagtggttgaaaatttcgttcgtccacatcctgagcagtatacgtggatcctcaagttgctgaaaacgcgtaaagaaggggaagaggatccttactgaggcagctttttcaggataatgagcttacccagcaatagtggacacacgctaagtgagtaaactctcagtcagaggtggctcatatgacaaaaaaacagtaccaaccagtaaaaaaccccgtaaatagcattcgcctgaatttcgcagtgaagccctgaagcttgctgaacgcatcggtgttgctgtcgcagctcgtgtgctcagtctgtatgaatcacagcttgtaagcggctcgtcagaactgtattgatatttactgagcggtcagttcaacgtaagcgagtgttatgcgccatggaagcttacccaggaatatgttatcaggcctcagcatggcgaagtgttgcaacgctggaagcagaatgaccgcggtcaacaacttgttttaccgcttcaattttaaaatcttcgggataacgcttaccgctcatgggcacctctctttaagccatttaaaatgactctgaggtgtctgttaaacccgtggcgattcaatctggatatagtggctaagaatacctttatttttttttttttttttttttggtttttattttttattgagttttgttttgtatattaaatatttgttgttgattcattatcacacaaaagaatgtatcataatgcaattgtttgatgtgttaaacgttataaacatattaattgtcgtgttttgtgcttgcttatcaaaaggatagttagcttgctttttttgcaaaatataataataaaataagttaaaggacgttataagagttaattctttggtcaggatatatttacgaaacaggtgtaaatatgttataaaaataaccaacgactagtgaataagtcgctcctgaaaaaataaaatatagaaatactgttatatccggctgcatgaacactaaaatgaatgagagatggagaacaccgatgaaattaaagtatctgtcatgtacgatccttgcccctctggcgattggggtattttctgcaacagctgctgataataattcagccatttatttcaatacctcccagcctataaatgatctgcagggttcgttggccgcagaggtgaaatttgcacaaagccagattttacccgcccatcctaaagaaggggatagtcaaccacatctgaccagcctgcggaaaagtctgctgcttgtccgtccggtgaaagctgatgataaaacacctgttcaggtggaagcccgcgatgataataataaaattctcggtacgttaaccctttatcctccttcatcactaccggatacaatctaccatctggatggtgttccggaaggtggtatcgatttcacacctcataatggaacgaaaaagatcattaatacggtggctgaagtaaacaaactcagtgatgccagcgggagttctattcatagccatctaacaaataatgcactggtggagatccatactgcaaatggtcgttgggtaagagacatttatctgccgcagggacccgaccttgaaggtaagatggttcgctttgtttcgtctgcaggctatagttcaacggttttttatggtgatcgaaaagtcacactctcggtgggtaacactcttctgttcaaatatgtaaatggtcagtggttccgctccggtgaactggagaataatcgaatcacttatgctcagcatatttggagtgctgaactgcctgcgcactggatcgtgcctggtttaaacttggtgattaaacagggcaatctgagcggtcgcctaaatgatatcaagattggagcaccgggtgagctgttgttgcatacaattgatatcgggatgttgaccactccccgggatcgctttgattttgccaaagacaaagaagcacatagggaatatttccagaccattcctgtaagtcgtatgattgttaataattatgcgcctctacacctaaaggaagttatgttaccaaccggagagttattgacagatatggatccaggaaatggtgggtggcatagtggtacaatgcgtcaaagaataggtaaagaattggtttcgcatggcattgataatgctaactatggtttaaatagtaccgcaggcttaggggagaatagtcatccatatgtagttgcgcaattagcggcacataatagccgcggtaattatgctaatggcatccaggttcatggtggctccggaggtgggggaattgttactttagattccacattggggaatgagttcagtcatgaagttggtcataattatggtcttggtcattatgtagatggtttcaagggttctgtacatcgtagtgcagaaaataacaactcaacttggggatgggatggtgataaaaaacggtttattcctaacttttatccgtctcaaacaaatgaaaagagttgtctgaataatcagtgtcaagaaccgtttgatggacacaaatttggttttgacgccatggcgggaggcagccctttctctgctgcaaaccgtttcacaatgtatactccgaattcatcggctatcatccagcgtttttttgaaaataaagctgtgttcgatagccgttcctccaccggcttcagcaagtggaatgcagatacgcaggaaatggaaccgtatgaacacaccattgaccgtgcggagcagattacggcttcagtcaatgagctaagtgaaagcaaaatggctgagctgatggcagagtacgctgtcgtcaaagtgcatatgtggaacggtaactggacaagaaacatctatatccctacagcctccgcagataatagaggcagtatcctgaccatcaaccatgaggccggttataatagttatctgtttataaatggtgacgaaaaggtcgtttcccaggggtataaaaagagctttgtttccgatggtcagttctggaaagaacgtgatgtggttgatactcgtgaagcgcgtaagccagagcagtttggtgttcctgtgacgaccctggtggggtattacgatccggaaggcacgctgtcaagctacatctatcctgcgatgtatggtgcctatggcttcacttattccgatgatagtcagaatctatccgataacgactgccagctgcaggtggatacgaaagaagggcagttgcgattcagactggctaatcaccgggctaacaacactgtaatgaataagttccatattaacgtgccaacagaaagtcagcccacacaggccacattggtttgcaataacaagatactggataccaaatcgctcacacctgcgccagaaggacttacctatactgtaaatgggcaggcacttccagcaaaagaaaacgagggatgcatcgtgtccgtgaattcaggtaaacgttactgtttgccggttggtcaacggtcaggatatagccttcctgactggattgttgggcaggaagtctatgtcgacagcggggctaaagcgaaagtgctgctttctgactgggataacctgtcctataacaggattggtgagtttgtaggtaatgtgaacccagctgatatgaaaaaagttaaagcctggaacggacagtatttggacttcagtaaacctaggtcaatgagggttgtatataaataatcctgagacggtgcggccacttcggccgcattagtaacacattcgtcccgttaatcaaaacataaagtagcgtccagcgttttattatgttgttctttctatcattccggggtgaccggggcttatttataaaagatatcgtacttaaaatgctgacgccaaaccggctattgtgcgtaattttacttattgccggatatcagctggtgtcggttatccatcatttctggctgactcaggcagcatcggtgcccggcttatcccgtgttagcgcgccggaaacagcggtaactggtgatcaaactgaagaacgttttgtttttacgttattcggcagggcatccccactatcatcggaggggagagcgcaggaaacaatgccttccctgtcagatgatctgctttcaggggaggatcttgacgtgagaggtatactttatagttcggttgcagagcattccgttgccatatttgcacataataacagacagttcagtctgagcgtcggcgaaaaagtacccagctacgatgctacgattagtgctatttttagcgatcatattgttattaactatcagggaaaaactgtatcactgcctctgcgatatgataataccgaaaaaaagaatgcatatgacaataataatttaacagttggagacgtgataacccaagataattttcgggtagaaagtgtttttgatattatgagcttttcagccgttacggttaataatacattaagcggttatcgcttgattccgggtaagcacagttcgttattttataatgctgggttgcatgataacgatctggccgtatcggttaatggttcagaattgcgtgataccagacaggcgcagcagataatgaagcaattgccagaacttaaagaaataaaaataaccgtcgagcgtgatggtcagttatatgatgcatttattgctgtaggagaaaactgattgttcaggaaatggttgaatgggcgtttgccggtacttgtgttcactacagtaattttgggggccattccagggtggggggctgaattttcggccaactttaaagatacggatattcaggagttcataaatactgtcagtaaaaatttacacaaaacggtaataattaatcctgacgtgcagggaaccatcactgtacgcagctacgatatgctgaacgaggaacaatattatcagttctttctcagtgtgctggacgtttatggttttgctgtggtcgatatgcacaacggtatactgaaagtagtgcgctcaaaagatgccaaaacgtcggcggtgccggtagctagtgatgtcagtcccgggactggtgatgaggttgttacccgggtggtccccgtaagtaacgtggcagccagagatctggcgcctttgctgcgtcagctcaatgataatgctggcgcaggaagcgtggtgcattatgaaccttctaatgttttgttgatgaccggacgtgctgcagtgatgaaacggttgatggagattgttgaacgtgtggataaggtgggtaatcgcagcgttgccacggtcccgctcacctacgcgtccgcaacagacgtagccagacttgttacggaactgactaaagaaacagataagacagctatacctgcttggatgacggcgaaactggttgcagacgagaggacaaactcagtgctcgtcagcggagagccaatctcccaacagcgtatcatctccataattaagcaactggatcgtcaggaggatgttcagggtaatactaaggtgatttacctgaaatatgcgaaggcgaaggatttagtggaagtcctgacaggtatcagcagcagtattgaaaacgactctaaaaagagtccgtcaacggaagccttgcgcaaaggagtgacgattaaatcccacgaacaaaccaatgccctgatcctgacgggggcccctgacgtcatccgcgaccttgaaaatgtgatttcgcagttggatattcgtcgtcctcaggtcctggtggaggccatcattgctgaaatacaggatgctgacgggctgaaccttgggatccagtgggtgaataaacatgccggtgtggcgcagttcaccagtaccggtttacctattaccacgatggttcagactcgtcagaacgaaatcttagacagcgatcagagcaatgccctgagcatgtttaacggaattgcagcggggttttatcagggaaactgggcgatgctgttgacggcgctctccacaagtagcaagaatgatatcttggcgacccccagtattgtcacgctggacaatatggaggccactttcaatgttggtcaggaggtcccggtactttcgggctcacagacaacctctggggacaatatttttaacacggtcgagcgcaaaacggtggggatcaaactcagggtaaaaccccagatcaacgagggtgattccgtgttactggagatagaacaggaggtgtccggtgtggcggacactgcagtagccaccactactgacttgggagcaaccttcaacacccgaacagtgaccaatgccatgctggtcgggaatggcgaaacggtggtggtcggaggattactggataagtcgatcagggggagtgagagtaaagtgccactgctgggggatatcccggtactggggcatctttttcgcgcaaaaagcgaacagacagctaagcgtaatctgatgctgttcattcggccaactattattcgtgagcgcgacggatttcgtcatgcttcggccgaaaaataccagtcgtttaatcaggaacaggtgcagtcgcgtggcaaagaaacaacggcgctgacgctgaatgaggaacagctcaggctgtcccccgatcaagacgatacggctttccggaaggtgaaagcggcgattgctgcgttttatgcgcaggagatgtaatgagcagagtagtacagaatgtcagtgaatcacgtccccttctgcctttttccttttcccgtacgcagagaattttgttgctgcgtgaacaggaggggaatcgagtgttctgcatggaggacacacctgccagtgccctgttggaggtgcgcagggtggctgaaggtcctctgaatgtcacaacagtgtcggcggaagcgtttgaaaaacagctggtgagcagctatcaacgtgattctgatgaagcgcgacaaatgatggctgagattggtaatgaaatggatttttataccgtcgcaggggagttgcctgaccgtgaggacttactggatgcgaatgacgatgcgccaattatccgcctgattaacgcaatgctgacagaggcaattaaagagaaagcctcagatattcatattgaaacttacgaacgccatctgcaggttcgctttcgcattgatggcgttctgcgggagatcctccgtttacataggaatctggcttcgttactgatttcacgcattaaagtcatggcccggttggatattgccgaaaaacgcgttccccaagatggccgcatggtactgcgtatcggtggtcgggcggtggatgtgcgtgtttcaacgttgccttcaaatcatggtgaacgcatcgtgctgcgtttactagacaaaaatagcgttagtctcgatcttgctgcactcggcatgtcgcagcagaatcagcgacacattgatgcactgatccgccgtcctcacggcattattttggtgaccgggcctacagggtcgggtaaaagcacgacgctttatgccgcgttaagcctgctgaatccccgagaccgcaacattatgacggtcgaggatcctgttgaatatgaactggacggtatcagtcagacccaggtcaacccgaaggtggacatgacctttgcccggagtctgcgcgctattttacgtcaggatccggacgtggtgcttgtgggggagatccgtgacggtgaaacagcccagattgctgtgcaggcctcgctgacagggcatttggtgctgtcaacgttacatacgaatagtgcagcaggcgcgctgtcgcgtctgcaggatatgggcatccctccttttctgctttccacctcattactggctgttctggcccagcgactggttcgcacgttgtgtccgcgctgtcgtcagccctgtcaggtcagtactgagttagcgatggacatggacattccccctgaaaccacgatctggcagcctgccgggtgtcagcactgcagtttcacgggctatcacgggcgcaccgggatccacgagctgttgctgattgacgatcgcattcggacggcaatctatcagggggagggggagctgggtattacccgcttggcagggagtcgctatctgacgctgcgtggcgacgggcgacaaaaggtactagccggtgagaccagttgggaggaggtggttcgcgttactgaaagcagattgcaggaagaggaatgatatggcgttgtttcattatcaggcatcagatattcacggtagaaaacgcagtggcattctggaggcggattcggcccgacatgcccgtcagttgctgcgtgagcaggcgcttattccagtcaggttggatgagaaacaggtccatcacaagcactcactgcggagtatcctgaggtttcgtccgcgcggggggagcagcgccgaactcgcgttactgacacggcagttagccacactagtggccgcatctctgccgcttgaagaggcgctggatgcgttgttgaggcagagtgaaaaaccgcgtcagcggaacttaatcgctgccgtgcgcaccaaggttctcgagggacattccttggccgcggcgatgggcatgtttccaggtacgtttgagcgtctttattgtgcgatggtggcggcgggggaaacatccggtcgtttggacgtggtgctcagtcgtctggctgactataccgagcagcgccagatcatgcgaaaccgtctactccaggcattgctctatccttgtgttctgacgttggtggcggttggggttattgccattctgcttactgcggttgtgccgaaagtggttgagcagtttattcatatgaaacagacccttcccttatctacccgcgtactgatgggggctgctgaggtgagccagacttggggcccgtggctgttactggccgcagcgctgggcgggatagcggggcgcatgatattacatcagccctcccagcgtctggcttttcatcatctgctgttgcggctgccggtcgtggggcgcatatcgcgcggtctgaataccgcacgttatgcccgcacgctgagcattcttaatgccagtgcggtaccgctgctccaggcgatgcacatcagtggtgacgtactgagtaatgactgggcccgtcatcagttagctaccgcggccgagttggttagggaaggggtcagcctgcatcaggcactggagcagacttcgctgtttccgcctatgatgcggcacatgattgccagcggtgaaaatagtggcgaactcgacagcatgttggaacgggccgccgacaatcaggatcgtgagttcagcacacagatgcaactggcgctgggattgtttgaaccgctgttggtggtgggtatggccggggtcgttttgtttattgttctggcaattctgcagccgctcctgcagctcaacaacatgatgaatatgtgaatccttctttaacagtcaacggagaaaaacatgcgaaaacagcatcagcgtggttttaccttgctggaaataatggtggtaattgtgatcttgggagttttggccagtctggtggtcccgaatctgatgggaaataaggataaggccgatcggcagaaagtgatgagcgacttggttgcgctggaaagcacgctcgatatgtaccggttagataataaccggtatccgacaacggagcagggactgcgggcactggtcagtaaacccaccgtgcaacctgaaccccgtaactaccggcaggatggttatatccgccgtttgccccaggatccttgggggggggattatcagctgttaaatcctggtcagtacagcgacattgatatcttttctcctggcccggatggtgtgccaaacactgaagatgatattggtaactggacgctcggtaacgcgcagccatgagtcagcgcggtttcacaatactggagatgatgctgatccttttgttgatgggcatcactgcagggctggtactaatgtcatttcctgactctgctcagaatcatctgcaacaacagcgggagcgtctgcaggcgcagctggattatgccttggatagaagccagcaggacggcttgctgatggggattcaggttcggtttgacggatggaaatttaaggttctgcagcgcggaacagcggaaagccccccgacattagctgagggaggggatatttggcaggggtatgtctggcaaacttggcaaccgcgacgtgcagccatggggggcaaacttccggatgatgtgcgtcttgagctgcagtatctcagaggtttgcagtggatgtctgagcatgatgacggggctgaacccgatattttgctgcttcccggaggtgaggtaacgccgttcagacttcttttcaggcaggtcggagaggaggccgttgtcgggctgcaggttgatgagaacggtttgatgactctttttgaaggtgaggtctcattgtgaaggggcaagaaggaatgacattactggaagtcatagtagctctggttgtgtttgcgctggcaggaatggcgctgatgcaggcctcgacccagcaggctgcggggatcggacggatggaagagaaggtgctggcaggctggttggccgataaccagatggtgcaattgcaactcgagaaaacttggccggaaaatggctggggcgagaagacgatcagcttcgctggcaccgaatggtatttacgctggggcgggccggacagcgacgtgccgcagccgcgctccttagaggtagaggtacggcgcactaaagaggagacgtccgccttggtttccttgcgtagcagtgtggttcgtgaatgagtcagcaacgggtaaaaggttttacgctactggaaatgctgttggcactggctgtttttgcagcgttgagcatcagcgcatttcaggtgctgcagggtggaatacgggcgcacgagctgtcccgggataaagtacagcgtctggctgagctgcagagagggatcagccagatggagcgagatcttacgcagatgctcccaaggcacagccgggggaatgaaggcctgctgctcgctgcacctcatctgctaaaaagtgatgactgggggatttcttttacgcgaaacagctggctgaatcccgccgggatgctgccgcgcccggagttacagtgggtaggttatcggttgcgacagcaaaagttagaacgcctgagctactttcatgtcgatcacccttccggtgtttctccggatgtcagggtgatgctggacggcgttcacgcatttcgtctgcgtttttttgttaacggtgattggcaggcgcgctgggacagtaccggcatcctgccgcaggctgttgaagtgacgctggttatggatgattttgctgaactgccccgtctgtttcttgtgagcaaggagaccgctgaatgaaattgcgggaacagggcgtggcgcttctggtggtattgctgatcctgtcgttaatggtaacgatagcggcggtgattgcggagcgcaacggtcggacatttttgcgtacagtagcgcagttggatcagctgcaggcaaagtgggatggctatacggcagagacgatagcaaaacaaatcttacagaggagcaggcaggagtcgccccggaaaacgcatctggcacaaaattgggcgcagtcagaacgacagtttgagaccagagggggagatgtgcgggggcagatcgtggatgcgcaggcctgttttaatcttaatgctattaattatggagtggtggatctgaccagtataccttatgccgccagaatttttcagcagctattaatcaacttgcaggtagagcttttacaggcccggcaagtgacggcagccctacgtgactggatcgatcgtgatgataagccggtaaggggcggtgctgaagacgaggtgtatatggggatggaacctccctatctggcagccaaccagccgatgcaggacgtcagtgagttacgccttatccggggaatagatgccaggctttaccgcaaacttttgccgtatgtttgtgtactgcctacgtcagatctgtctgtgaatgtgaatactctgctggattcacaggcgccgctgctggcggcgctctttctgacgaaaccggacagtcttccggtgacggaattactgcagcggcgaccccgtactggttgggagagcgtggcggcgtttcttgacgcgccaccgcttaaggacattgacaccagtgcggccatgccggtattggccgtcagcagcaactattttctggttcggttacatgtgcgctccggggaacacctgttcagtcagcagactttaatgcagtggagggaggagcgtttccggatcattcagcgacagtatggattaacgatgagggaggttccctgaaaaaaaataacaaacatgtcgaggctggtcggctttttctgcgactgccggaggatgactcggagcctttattgtggaggctgattgcgccagaggagacaggagccggcagtgtggcagtcggagaaacggatccgcagttagtcggtttgctgtcccgttatcccgcctgggtgctggttccgtcaggcagaattgccttccatcaggtcacgctgccacaccgcacgtggcgtcagcgtttgcaggtgctgccctttcttctggaagagcagttggcgacagacattgagcagctgcacttcgccattcttcatcagtcgggtgacaggtgtgatgtggcggtggtcgaaaaagcggttatgcatcgctggttagcgtactgtggacaacttggggttcgggaggtgaggttgctgcctgacgtactgatgctgccgttggcaactgaaggatggagtgccgtaaagcttgccgggcagtggctgtttcgccgggatcgttacgccgggatgacggtagagttatcgtggctgacacatttcttgtctcttactgcgccgccggtgattgagtcctactccgtgccgccagtaccgtgcccgggtccgaagaccactgagtggcgaaatcagcccggacgcgatctgctgcagttggtggccgaaggtgacgggtatgatggcgcagatctgcggcagggagaatttgcccgccagggaacatggtatgcacgatttcgcccatggaggtatgtcgcaggggctctgctggcctgtgtttttctggccgggagcaacgcggggctggcacattatcggctctggcagcaggctcaattctggcggtatgagagcgtacgtgtctatcagcagctgtttccgagtgaaaaggcggtgaaggatccccgccggcagatgctgagacatctgcaacagtcgacgggtaacaatataccggaactcgggagcgtgatgcgccagcttcagcaactgctgtcagaaacctcaacgatacgcttacaggcactcgcctgggacagcagcagccagacactgaaaattgatttgcaggcggcttcttttcaggcgctggaacactttcagcagatcgccggagaaaaatacctcatccagcctggtgagatacgacagcagccgcagggggtagaaagtcgtctgatcctgagagtgaacaatgaacgagcttaaaaaacgtttgcagtatgttagcccccgtgagcgcaggctgcttatcggatgtgttgccttactggttgttgtttttgtctattacgtcctctggcagccctggctgatacgagaggataagtggcggactgtagttacccgtgaaaaaaacacagtggagtggatgaaacaacaggtacccaacataaagagacgggaggcaagtatgcctgaacagggggagccgttaggtttatctgcggccgtgacacgtacttcagccgcatacggtgtatcggtcacccggttgcagcctcaaggggagcgtctggccgtcaccttagccccggttgaatttaatgcgctgatgcagtggcttacgcaactggagcgtcggcaccgtattcgtaccatggtatttgatgtggccgcgcagggcaacccacccggacaggtaacggttaatcggctggttttgtcccaagatgacgtaaacaaggacgcttcgcttagtcgctgatgtcgtaatttacagattaatgcttgatgtaaaaattggacttataaaggaggatgtgtgagtagtttgccggaatttgcggttgattatcccttgttgtggctcatctgcaccggagggctggggggcgttaccggcagttttcttaacgtcgtgattcatcgtctgccgataatgttggagaggcggtggcggcgtgaagcgctgacgctattggcacattctgtgcctgagtccgggccggcctttaacctgatgataccgcagtctcattgtccctgctgttttcatccgctcggcatcagggataacattcccctgttaagctacctatttctgaaggggaaatcacgctgttgtggcgagcgtattcccgtttactacccgctagtcgaaataacgaactcagtgttattcattctggccgcgagcaggtttccaccagggctgacattagcggctgcctggctttttatttccatgctgttggttctggcggttattgactgccatacggcgctgctgccggatgtgctgacgttgccattgctctggcttggcctgttattcagtttacagagaggcgttgtcaccttagaggaggcggtagtgggggcggtatctgggtatctctgtctgtggggactgtactggctttttcgtttcgctaccgggagggaagggttaggttacggtgattttaagctagctgcggcattgggagcatggatgggttggcaggcattaccctcaatacttttgtttgcctcagtcagtgggttaatcgtaacagtactgttgcgtattgtaacagctacggactttacccgcccgctgccttttgggccgtggctcgctttgagcggagtgtgccattttttgttgatgtagcgttcggttaccggggctagtaataaaaacggctcagcggataaaagaactgttgtaaaccggtatcaggttaaacgatacctagtaaaaaatgatgggtaatattttgaaaaaactgaattgtatcgcgtcattactagtcttagtgactatctctggttgtcatcagtcaccctccatccataagcaggccactgttcctccgagcgaacaactggaacaaatggcgtcgattgtctctgcgacacggtatctgaaaatgagatgtaaccgtagtgatttaccagatgaacagtcgatcctaaatgtcgctaaccggatcgctatcgggaaagggtggcagtcattaactcaggaggatatacgtaaacacagcgatgatatctatgtgcgtctgactagggacagtacgcctgagtatataaaatgcagagaattcaatcggcggctggtcccatttatcggtgaattattggcaaggggtcgtggataatatgaaccgccccggaaatcctggagactaaactccctgagaaagaggtaaacagcatgaataaaaatgggtcttcccttgtagtggtggctgaaggcatgatgattgtagtggcacactgaatttggccacctgaacagaggtgatatgctcacctcagaacaacacaggtgctccaatgaaaaaaagaaatttcagcgcagagtttaaacgcgaatccgctcaactggttgttgaccagaactacacggtggcagatgccgccaaagctatggatatcggcctttccacaatgacaagatgggtcaaacaactgcgtgatgagcgtcagggcaaaacaccaaaagcctctccgataacaccagaacaaatcgaaatacgtgagctgaggaaaaagctacaacgcattgaaatggagaatgaaatattaaaaaaggctacaaccgcgctcttgatgtcagactccctgaacagttctcgataatcgggaaactcagagcgcattatcctgtggtcacactctgccatgtgttcggggttcatcgcagcagctacagatactggaaaaaccgtcctgaaaaaccagacggcagacgggctgtattacgcagtcaggtacttgagttgcataacatcagccatggttctgccggggcaagaagcatcgccacaatggcaaccctgagaggcttcagaatggggcgctggcttgccggcaggctcatgaaagaactgggactggtcagttgccagcagcctgcgcaccgttataaacgaggtggtcgtgaacatgtcactatcccgaatcaccttgggcggcagttcgcagtgacagagccaaatcaggtatggtgcggcgacgtgacgtacatctggacggggaaacgttgggcataccttgccgttgttctcgacctgtttgcaaggaaaccggtaggttgggcaatgtcgttctctccggacagcagactgaccatcaaagcgctgaaaatggcctgggaaatccgcagtaaaccagccggggtaatgttccacagcgatcagggcagccactatacaagcaggcagttccggcagttactgtggcgttaccagatcaaacagagtctgagtcgacgaggaaattgctgggataacagcccgatggagcgcttcttcaggagtctgaaaaacgagtggataccggtgacgggttacatgaacttcagcgatgctgcccatgaaataacggactatatcgttgggtattacaacgcgctcaggccgcacgaatataacggtgggttgccaccaaatgaatcggaaaaccgatactggaaaaactctaaagcggtggccagtttttgttgaccactacatcccgtcagccgatttacgggccgtaagtaacgaagttggatgcaaatgtcagatcgtgtgcgcctgttatggctcggctggtaagagagccttataggcgcatttgaaaaaactccagctataccggaagagatttattattaacaggagaggtttgcttttctgtgtaggtttagattttgtgtttgcagggtaaacaaaactgattaactcgtcatttcggtaactgaaatagtttgctgtattctgtttacaatctctttaataaggcatttgtcacgtggctattcatatgaaaatcatacgttatcttacaaatcaatcatctgagtgttataatataacttagctgtgatatgtgtaagaatgtttaggcaatatattattatcgctaatgttgttttggttgggagagattctccttgcggtagctttctgtttttagatgcttcttgcttaaaaggatataatttctgttcttttatatagggttctttacatttactgagttttcttatttatttaaacattatgaaatctaatgcttttgacgtcatggggaaggttgcatggctatgggcctgttctcctctgcataaaaaatggccattatctgtttttgctattaatgtcatacctgctattcagacaaatcaatttgctctcttaataaaggatgagcttcctgtagctttttgtagctgggccagtttagatctggaatgtgaggtaaaatatataaatgatgtaacatctttgtatgcaaaagactggatgtcgggagaaagaaagtggtttattgactggatagctccatttggacacaacatggagttatataaatacatgaggaaaaagtatccttatgagttattcagagcaataaggttagatgagagcagtaaaacaggaaaaatagctgaatttcatggaggggggatagataaaaaactggcatcaaaaatattcaggcaataccatcatgaacttatgtctgaagtaaaaaacagacaagattttaattttaatattgagaaagaaaactaatatgacagtaaataaaataaagaacattttcaataatgcgacattgactacaaaatcagcatttaatacagcatcatcaagcgtacgttccgctggaaaaaaactcatattattaatacctgataattatgaagctcagggcgtgggtattaatgagttggtcaaagctgctgatgagcttggaatagaaatacaccgtactgaacgagatgatacagcgattgcaaaccagttttttggtgcagcagaaaaagttgtaggattaactgaacgtggtgttgcaatattcgcaccacaacttgacaaacttctgcagaagtatcagaaagttgggagtaaaataggaggaaccgctgaaaatgtaggtaataatctgggaaaagccggaacagttctctcagcactacagaattttacggggattgctttatcaggcatggctcttgatgaattgctgagaaaacaacgggaaggagaggatataagtcagaatgatattgccaaaagtagtattgaacttattaatcagcttgtagatacagtatcaagtataaacagtaccgttgattcattttctgagcagcttaaccagcttggctcatttttatccagtaaacctcgattaagttctgttggtgggaaattacaaaatttaccagacctgggccccctgggggatgggctggatgttgtctccggaattctttctgctgtatcagcaagctttattctgggaaacagtgacgcacatacaggaacaaaagctgcagcgggtatcgaactgacaactcaggttcttggaaatgttggtaaagctgtttcgcaatatattctggctcagagaatggcacaggggttatcgacaacagctgcaagtgcgggtctgatcacatcggctgttatgctggctatcagtcctctttctttcctggctgctgcagataaatttgagcgagctaagcagcttgaatcatattctgaacgatttaaaaaattgaattatgaaggggatgctttactcgcagcctttcataaagaaaccggagctatagatgcagccctgacaacaataaatactgtcctgagttctgtatctgcgggagttagtgcagcctccagtgcatccctcataggggccccgataagcatgctggtgagtgcattaaccggtacgatatctggcattctggaagcatcaaaacaggctatgtttgagcacgttgcagagaaattcgctgctcggatcaatgaatgggaaaaggagcatggcaaaaattattttgagaatggatatgacgcaagacatgctgcgtttttagaagactctctgtctttgcttgctgatttttctcgtcagcatgcagtagaaagagcagtcgcaataacccagcaacattgggatgagaagatcggtgaacttgcaggcataacccgtaatgctgatcgcagtcagagtggtaaggcatatattaattatctggaaaatggagggcttttagaggctcaaccgaaggagtttacacaacaagtgtttgatcctcaaaaagggaccatagacctttcaacaggtaatgtatcaagtgttttgacatttataacaccaacatttaccccaggagaagaagttagagaaagaaaacagagtggtaaatatgaatatatgacatctcttattgtaaatggtaaggatacatggtctgtaaaaggcataaaaaatcataaaggtgtatatgattattcaaaattgattcagtttgttgaaaagaataacaaacactatcaggcgagaataatttctgagctcggagataaagacgatgtggtttattctggagcaggctcatcagaagtatttgctggtgaaggttatgataccgtatcttataataagacggatgttggtaaactaacaattgatgcaacaggagcatcaaaacctggtgagtatatagtttcaaaaaatatgtatggtgacgtgaaggtattgcaggaagtcgttaaggaacaggaggtgtcagtagggaagcgaacagagaaaatacaatatcgtgattttgaattcagaaccggtggaattccttatgatgtaatagataatcttcattctgttgaagagctcattggcggaaaacatgatgatgaattcaaaggcggtaagtttaatgatatattccatggcgcagatgggaacgattatatcgaaggtaattatggtaatgatcgactatacggcgatgatggggatgattatatatccggaggacagggagacgaccagttatttggtggtagtggaaacgataaattgagtggaggggatggtaataattatctgacaggaggaagcggtaatgatgagcttcaggcacacggagcttataatattctgtcaggtggtactggtgatgataaactttatggtggtggtggtattgatcttctggatggaggggaaggtaatgactatctgaatggtggttttggtaatgatatttatgtttatgggcaaaactatggtcatcatacaattgcagatgaaggaggtaaaggagatcgtttgcacttatctgatattagctttgatgatatcgcatttaagagagttggaaatgatcttatcatgaataaagccattaatggtgtactttcatttaatgagtcaaatgatgtcaatgggataacatttaaaaactggtttgcgaaagatgcctcaggagcagataatcatcttgttgaggttataacagataaagatggtcgagagataaaagttgataagatacctcataataataatgaacggtcaggttatataaaagccagtaatatagcatctgaaaaaaacatggttaatatcaccagtgttgccaatgatattaataagattatttcttcagtttcagggttcgattcaggtgatgaacgattagcatctttatataatttatccttacatcaaaacaacacacactcaacaactttaacgacaactgtctgagactaaaagaggaggtgatggccattccaggaggaatggtcatcgttatatgatgagtaaatgtagttctcataatagtctgtatgcactgatattgcttgcacaatatcataatataactgtcaatgctgaaactataaggcatcagtataatacccacacacaagattttggggtgactgaatggttactggcagcgaaatctattggcttaaaagcaaaatatgtagaaaaacatttttccagattgtcaataatttctttacctgcgttgatatggcgggatgacggtaagcattatatattgtctcgtattactaaagattcatcacgctatcttgtttatgatccagaacaacatcagtcactaacttttagtcgggatgagtttgaaaaactgtatcagggaaaagtcattctggttacgtcaagagcaacagtagtcggagagttagctaaatttgatttttcttggtttatcccctctgttgtgaaatacaggaggattttacttgaggtgttaactgtttctgcttttattcagtttcttgcgttaataacacctcttttttttcaggttgtaatggataaggttttagttcaccgggggttttcaacgttaaatattatcacaatagcatttattatagtgatactttttgaagtgatattaaccggagccagaacttatattttctctcatactacaagtcgtattgacgtcgaactgggtgctaagttattcagacatttgcttgcattgcctgtttcatattttgaaaatcgcagggtcggagagaccgttgccagagtaagggaactggagcaaattcgtaattttttaaccggacaagcgttgacatcagttcttgatctatttttttctgtaatatttttttgtgtcatgtggtattacagccctcaattaacactggttatattattgtcactaccttgttatgttatatggtcattgtttatatcacccttattacgtcgacgtcttgatgataagtttctcaggaatgcagaaaatcaagcttttcttgtcgaaacggtaacagcaataaatacaatcaaatccatggcagtatcaccacagatgattgctacatgggataaacaactggccgggtatgttgcttccagtttcagggtaaatctggttgcaatgacagggcagcaggggatacagctgatacagaaaagtgtaatggtaattagtctatggatgggagcacatcttgtcatatcgggagagataagcatcgggcagttaatcgcgtttaatatgcttgcaggtcaggtcattgctcctgttatcagactggctcatctttggcaggattttcagcaggttggtatttctgttgagcgccttggtgatgtattaaatacaccggtagagaaaaagtcaggcagaaatatactgccggaaattcagggggatatcgaatttaaaaatgtcagatttcggtattcttctgacggtaatgttattttgaataatattaatttatacatatcaaagggggatgttatcggtatagttggccgttctggttcaggaaaaagtacattaacaaaactgcttcagcgcttttatataccagagaccggacagattttaattgatgggcatgatttatcacttgcagatccagaatggttacgacgccagattggtgttgtattgcaggaaaatatactattaaatcgtagtattatcgataatattacattagcttctccggctgtatctatggaacaggctattgaggcagccagacttgcaggtgcccatgattttattagagaactaaaagaagggtacaatactattgttggagaacagggcgttggtctttcaggagggcagcgccaacggatcgcaatagcccgggctcttgttacaaatcctcgaattcttatttttgatgaagcaaccagtgctcttgattatgagtcggaaaatataataatgaaaaatatgtcaagaatatgtaagaacagaaccgtaattattattgcacacaggttgtcaactgtaaaaaatgcaaacagaataattgttatggataatggctttatttctgaagatggcacacataaagagcttatctccaaaaaagacagtttatatgcatatttatatcagttgcaggcataacgtatgcgcttttacatgaaaggtttatgggatttggtttgccgttataagacggttttttctgatgtctggaaaattcgtcacacacttgatgctcctgtgagagaaaaagatgagtatgcatttcttcctgctcaccttgaactcattgaaacaccagtatccagacgttctcattttgttgtatggagtattttattatttgtaattatatctcttctcttatctgttcttgggaaagttgaagtggtttcagtagcaaatggtaagtttactcatagtggaagaagcaaagaaataaaaccgatagagaatgcgattgtagaaaaaataatggtaaaagatggctcttttgtaaaaaaaaatgatccattagttgaattgacggtgcctggtgttgaatctgatattttaaaatcagaagcatctttgttgtatgaaaaaacagaacaatatcgctacgcaattctttctgaatcaatacaacggaatgagcttcctgaaataaggataacagattttcctggcggagaagataatgcgggaggtgaacattttcagagggttagctcattaataaaagagcaattcatgacatggcagaacagaaaaaatcaaaagcagctcacattaaataaaaaaatagttgaacgggatgcagcgcttgctcgtgttagcctgtatgagcatcaggtatcacaggaaggaagaaaactcaatgattttaagtatttgttgaataaaaaagctgtttctcaacattcagttatggagcaggaaaatagctatattcaggcaaaaaatgaacatgcagtctggcttgcacaggtttctcaacttgaaaaagaaatagaacttgtgcgggaagaactggcactggagacgaatatcttcagaagtgaaattatcgagaagcacagaaaatcaacagataacattgtgttgctggagcatgagcttgaaaaaaacaggcagagaaaagcatcatcttttattaaagctcctgtgagtggtactgttcaggagttaaatatacatacagaaggtggtgttgtcacaacagcagaaacgctgatgattattgtccctgataatgatattctcgaagtaacagcatctgtacttaacaaggatatcggttttatacaacctggacaggaggtcgttattaaagtagatgcatatccatatacacgtcatggttaccttacagggaaagtaaaaaatataactgcagattctgtttctgttccggatacagggcttgtatttaacgtgattatatctgttgatcggaatgatatacagggagaaagaaaaaaaatccctgttacagctggaatgactgttatggcagaaataaaaaccggggtgcgtagtgttatcagctatcttcttagtccattaaaggaaactattaatgaaagtttacgtgaacgttagtatataaataacatattggctttttatatgatatagatttctgaaataatcttgtaaagattatctatgttatttaaacaaactatgatacagtttttatctttaaaaatagttaatggaatggatagtattaaattacttgataaagttattatctatcaacaacagaatgagcaattatatccagcacaggaacatcttcttttacaactttgtatgcgagttaccaaaaaacttactgatatattaatgcctccctgaagggggatggtataaacgatacaacgcttatgcttctagccttgttatccagtactgataatttctgcttatcttcgactgaactcagtgaaagattagatgtttccagaacatatatcaccagagcttgtgattctctggaaaaatttggttttattaaacgtatggaaagtaaggaagatcgacgtagtaagaatatttatctgacttcagacggtaatttgtatttacagcggaccacaaggatatatggacgctatttaaaaaaatatggagcaaccttacagatgatgaaatcaaaacatttaaaataatcagcaaaaaggttttatctcaaaatatttctcagtaatattacatgtaatcatgtatataaatcctgagttcttatttttataatttattattctgcaattgtgtaggggggatagatactggttattccccctcttttttctggtaaggaaaatcagagttacgctatgtggattttgaacgtatttcaggtgcataaatctgtcagaatctacatagcgcatttttcagttttcaattgtcacttacatccatccattgatagatcattagcgtcctggcattaccccaattctcccaaaaacggcaaaccagccctcagcccgcgccacgactggcttaatacgggatccctgctgcaaaacgtacctttacgtatttggttttacccgcaataatgcgtgataagcaaacaaaaggatccgcacgctgcgatttattgtcgtggaaggatccgggcgttcaggtcagaatacctgtatccataaacagtgcgtgtgctacgtgaaaaataactcatgaacaatgtcattcccctgcagaattcaccagaacgcgtcttcctgttacccattgcgccgggggtggattttgcaacagcgctctccctgagaagaatggccacttccacaggggccacaccggcctacctgctggccccggaagtgagtgcccttcttttctatatgccggatcagcgtcaccatatgctgttcgccaccctctggaataccggaatgcgtattggcgaagcccggatgctgacgccggaatcatttgacctggatggagcaaggccgtttgtgcggatcctgtccgaaaaagtgcgtgcgcgacgcggacgcccgccaaaagatgaagtccgcctggttccgctgacggatataagctatgtcaggcagatggaaagctggatgatcaccacccggccccgtcgtcgtgaaccattatgggccgtgaccgacgaaaccatgcgcaactggctgaagcaggctgtcagacgggccgaagctgacggagtacacttttcgattccggtcacaccacacaccttccggcacagctatatcatgcatatgctctatcaccgccagccccggaaagtcatccaggccctggcaggtcacagggatccacgttcgatggaggtttataccagagtgtttgcgctggatatggctgccacgctggcagtgcctttcacaggtgacgggcgggatgctgcggagatcctgcgtacactgcctcccctgaggtgacggcatacgcgcttccttatataagctgtggtcagcagaacagacataacataagctggagcatgtatataagctgtagtgagtaagtcatgttttatgaagggagcaatgcctcagcatcaggttacggggtgactcacgtaagggaccggcagatgacagctcagctacaggcagcactgcaggaaactgaatataaactgcagtgagcagaccactcactgcacctgataatataagctgtagtcagtaaaggaacactcttcactgactacagtttatgttcagcgggatttgaagagtttttccaggtcatccagcgtgatgcccagtttctcaagcagggcaagcttctccgccatctccggactgactttttccgcaggtgaaggtggcaacggattttccttactctcatcattcggtgcttttaaccggggacgccggtagtgaatgcagaagagttttgtccgcccccgctggatctccgtgtaatcaagatatccaatctcgcgcagctgctccattgcccgtctgaccgtctggttctgggaaaatacaggagacttcagattgaggcgtgcacgcagccgcgccagcgataccggtgccggatcccggggcaggctctctataaaggtgtagagtgcctgggcggactcccgtcgcttcagggcattaatcgccttaagctggagaaggacctttctgtcaaactggtacagttcaaaaaggcggggatcagcctgtaactgaacaatatcccgttcagtatcgtagtaggctgactgtaccagatgggtgatgtattcccgggtgtgcttctcatcggtgcgggaaaaggagatcacggtaccggcaatgcgtttcagggaagggctgatgcgctcacgcagcctgcgtgatgactggcttgaaggtataccacacagttttgcaaactcgacaaaaggcagttcaactttgtcaccaattacgttatggcgggcaaaggaatgaatgatccccacccaggtcttgaaatcgttatccatatccaggcgggggccggtgatctcaaccttatcgaatccctcagcacgggccagggaaagacgtgtcagctcttccgtggcatcagtacgtgacagtgtattttttttactgttcttcagtgatttaagggtcggtacaaaaacgcccagacgcatcagcgccacaggttgtacggtgttgttattgtttggtgtcagtgtcaccagctcaccggacgacttatccacctcgccgaacagttttttgatgtctgaattttcgttttccagaaagcctcctgcctgtggacagtaaaagaataaacagcaaatcgtgtgtcagagccccgctaactgactgaagaaaaacctgcagcctgtatttaacagctgagtctggcgtactgaccatagtttatgtcattaacttacttcagtatatggattactgaatacagcttatcattagcatgttacagtttatcagtaacatgccactgcttatgtgatcgtggtcccggcccatgagtgacaaggtttgcagcggtatggggatctttaatggatcctttgttgatcattcatggatctgtttactggatcgagcctccggatatgtggataaatcattccagggaaacagcatacacaaccgcttataagggtgcctgttcgatgaacttaagggttttcgggttaaagtcgtccctcaggtactgcagggcattctcaaggcagttcatgccgtgagtcagctcattactgtcattgagaaaggaaaagtgcgtcgcccacagtgagcctgattcgatgatgcccttcaggccgttcaggtcagtgtaatgataaatcttcatctggcagcctcctgactgtccgggccctgttcgcactcagttttttgcacgtcagacagaaacgggaacaccgtaatagcggcttcccttgcttcttctatcgaccgttcccgggcctgccattccggatctgctgccagcacttcgtcggcggtatcgcgtaaccaggcatacagctcttcgccaccatcgagatcaatctggcgggtttttaccgggtcctcatgcttcatgatattacgcaacagcttaccaatctgcccgtcagattcgacaggttcgtaaggaatgtagtccggatattcgtcgaattgatccagcgtcaaatcgatgtactctccgtccagcaatacgatgacatgcccgtgaactgttgagttttccgcttcatgaaagccagcgttcccttccataaaaatgatgcacggatggcatctctctcgttctttgaggtagtacgccagagtattgctggctaaatcgcagctgctgtgcgggaaattcctcagttccgttttccagcggggaaaatgacgacacccgtcagcccgttcaccgccaccaagctccagtgcccgtcgaaatgcctttatacgtaatactctttcctgtctcatttcttcaccttcccgtcctggcgggccagagccagcagttcggtctgaagctggcggccgtcctcccgggcttccttcagctccgccttcgtgtcctgcagctgcgccgccaggtgttcgccggtggcggtcaggcgggccacctgctcgcgcagcggcagcgcctccgcgcgtagctcgcgtacctcctgcagcaggcggtcacgttcggccaccacctcgcgcagcaccgccagctcgctttccagcgcggccacgttcgccagcgcctcatcccgctccttgtcggcccgggcaatgtcgtcgtcggcctgctcgcgcgccgccagggccccggcttcagcctgtttcacggccgcctgccacagcagccccagctggccggtcagcagctgcgccagctccggcggcaggggcgtggcctgctcgcgctggcgggcgcggaacgcgcgcatcaccggggagatgtgggacagggagccgccgccgaggtgctgacggacctgctcgttggtcgggttcggggtgccggcggcgatcagggcggcggcggcgtcttcaatgcggcggacggtgtccggggagagggatgtcatggtctggctccggtttctcagggaatggcgccatcgtatgcccggtatgaaaaatacacaatacatacaatacaattcatacatacagtacagaacttacatacactctttctcttttcctggtcagatccggtttctggtggttacggatcttcctctccctccgcacagcgttacatcccgtcagcacagcatgcagtgcctcattcagttgcccatggcactatatgttgtgttgtatctctggactgtgatgcgccgcgcaggggcggaaaacagcgatatgatgattttctcaggtggtacacttccggaaagtcgtttattcaaataaagtcggatccatacgaaacgggaatgcggtaattacgctttgtttttataaggcagattttaatttttattggttaacataacgaaaggtaaaatacataaggcttactaaaagccagataatagtatgcgtatttgcgcgctgatttttgcggcataagaatatatactgatatgtatacccgaagtatgtcaaaaagaggtgtgctatgaagcagcgtattacagtgacagttgacagcgacagctatcagttgctcaaggcatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctccgttatacacagccagtctgcagtcatggtaccggcagtgtattctgccggacagcctgcatcgctgcctgttgccattgattatccggcagctctggcacttcgccagatgtcgatggtccatgatgaactgccaaaatatctgctggctccggaagtgagtgccctgctccattacgtcccgaatctgcaccgcaagatgctgctggccacactgtggaacaccggagcacgcattaatgaagcactggcgctgacgcggggggatttttcgcttgcgcctccgtatccgtttgtgcagcttgcgaccctgaaacaacggaccgaaaaagctgccaggacggcggggagaatgcccgccggtcagcagactcaccggctggttccgctctctgactcctggtacgtcagccagctgcagacgatggtggcaacactgaaaatacccatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgctggtataccgctgaaagttctgcaaagcctgatgggacataagtccatcagttcaaaggaagtctacacgaaggtttttgcgctggatgtggctgcccggcaccgggtgcagtttgcgatgccggagtctgatgcggttgcgatgctgaaacaattatcctgagaataaatgctttggcctttatatggaaatgtggaactgagtggtgaaccgccccggttttcctggagagtgttttatctgtgaactcaggctgccagatcatcgtttccgatggaagcataataagctttttctgcttctgccggaggagtatggcccagccttcccagcaatcgtcgattgttataccagtccacccacgttagtgtggccagttccacttctgcacggtttttccagctcttacggtgtattacctccgctttgtaaagaccattgatgctctcagccatcgcgttgtcatacgagtcgcctgtactccctgttgatgccagtaatccggcttcttttagtcgctccgtataggccagtgacacatactgagagcctttatcgctgtgatggatggtgccagacggacgacgggcccacaacgcctgctccagcgcatccagcacgaatgtcgtttccatagacgatgagacccgccaccccacgatgtatccggcaaacacatcaatgataaacgccacatagacgaagccctgccatgtgctgacgtaagtaaaatcagccacccacagctggtcaggtcgttctgccacgaactgacggtttacgcggtcgcctgcggcaacggctttccggctgatggtcgtacggacctttttaccccggagaacaccggcaagtcccataaccgccatgagacgtgccactgtacatctggccaccctgattccttcccgtaacaactgacgccagactttacgcacaccgtacacctgatgattttcatcgtatacgcgctgtatctctctcttcagccagtcgtcgtgctgcgcacgggcactgcgtttatccggatgatgtcgctgttgctgacaatggtaatacgttgacggggcaatatgcagttcgctgcataccggtccgaccccgtactgctcacgcagcttatccagcagtggcatcattttttccagaggcggtcgaactccgccttcgcaaaataagcggaagcctggcgaaggatatcgttactgcggcgcagttcacgattttcacgttccagctctttcagacgctgacgttcagcgctggtgagcccaccatcaccgcccccggtatcccgctcatgctggcgaacccagacacgcagagtctccggcgtacagccaatctttggggcaatggaacaaattgccgcccactgtgagtcatattcatcctgactttccagaaccatacgaatcgcccgctgacggacttcgggggaaaaacgagtatttttagtcatcctgtttacctctttctcagggagtttagtctccaggaaacccggggcggttcacagtaccgtaagccggatggctcaggcatcgtctctctgaaaattgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaatgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccactcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacacagccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtgttgtcggtctgattatcggtctgggaccacggtcccactcgtgttgtcggtctgattatcggtctgggaccacggtcccacttgtattgtcgatcagactatcagcgtgagactacgattctatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgccggcctcctcacccggtcacgtttcgtcgttcctcctccacgcgctgcggcttcggggccgcacctgcattcgtatgcggtcgcccggttacaggtgcggcacggcctgatggaggccgcatgtgagaggagaattcccatgccaaactggtgctcgaatgtgcgacatgaagtcgcctgaataattgttccagcggagttcgattccgtcagggaacctgatgttccgtcatcagtagcctactgacacatgcgtcactggtaacggtggggtgtgaagctgtcaggacaatgaaaccggatcttcggatcgcatgaaaccgtgaggttacatgtaatctgccagcatcaggcggaggaggtctaggctcggtagcatgactaacatatgtgaactgctgaagcgtcgttaaccagaacaagccaaagatgctgacaggcttgaaccaaaaggtatgtggttggttactcctctgtttgctaggggtacacggacaataaaccaccggtgttgtgagcagagtctaacctactgttgttattcaggtggaacatggtaagcccgtatcgctgcctcgtgaggcaggttaaccgcaagggatactgttggcggtgcgggtaaaagaaggtggaaaaagcgaatgccagtctgtaatggaccggataagggttgagcccggcaacattaccctacgcgaaagcgggcagacttccactgggtctttcattacgagagagtttgagtaatcttccagaaaggaaaagcagatgactgagcaggctacaacctgtaaaggtgcgtccttacttaacggtgactcctggcacagtatcaactggcgtcagtgctatcgggaagtgcggagactgcaagcgcgtatcgtaaaggcaacacgagaaggtaaacatggcaaggtcaaatccttgcaatggatactgactcactcgtttagtggcagagcagttgctgtcagacgagttacagagaatagcgggaaacgtactcctggggttgatggtcagacatggtcttccccggaggttaaatttcttgctattaacctgctgaaacggcgtggttacaaaccacagccacttaagcgggtttatatacctaagtcaaatgggaagtctcgtccccttgggatacccactatgaaggatcgggcgatgcaggcgttgtatttgctggctcttgagcccgttgctgaagtcactgctgaccagagatccttcggctttcggactggaaggtctactgcagatgcgatagcacagtgcttctgtgttcttgcgcagaaaacatccgctgaatgggtgcttgagggggatatacggggatgctttgacaatatatctcatcaatggctaatcgataacacctcaacagacagacaaatcctgacaaagtggcttaaagcgggttacagggaaaaggggcagttattccctgtaaattcaggaactcctcaggggggaataatttctcctgtactggctaacattgctctggatggactggaggcgcttcttgcttcggagtttaaaaagagaacagtcaagggacgattggttaacccgaaagttaactatgtgagatatgctgatgattttattatcactggagagtcaaaagaacttcttgagtctcaggtattacccgtcgtcaggcggtttatggctgaaagaggattaatgctttctccggaaaagacgaaaatcacacatatcgaggaaggatttgattttcttggacagaacattcgcaaatatggcggtaagatgctgatcaaaccctctaaagccaatgtcagttcctttttaaagaaaatacgcgctgtaatcaaaggcaacaaagctatggatcagcttacgttgatccgcatgctgaacccaatgatcaaagggtgggcggcttaccatcaacacattgtggccaaggtcgcatttaacaaagttgacaatgagatctggctggctttatggcgttgggctgttcggcgtcatcccaataagggaaagaagtggattcggaaaagatatttccatcaacaaggtgcccgaaactggtctttctccacggctaccggagaactccttgccaacggtaagcctcagtatgcaaatctgaggaaagcaatcgatacgcctatcaaccggtttaaaccgattaaaattgcagctaatccgttcgatcctcaatgggagatgtactttgaggagcgttgtgcagacaaaatgcggcacaaactgcaaggacggaaaaagctcattcaaatctggtttgagcagcggggccgatgccccatatgtgatgagaggattacatctgattcccagtggcaggttcatcacatcatacggcgagtcgatggagggagcaactgcctctccaatttgattatgctgcatccgatgtgtcacacacttgttcatgcgaaaggtatacatgtagtgaaaccggctcatgagagtgggcttagaaaggcttgagccgtatgccgggaaactggcacgtacggttcttagggggcggtgatgcagtaatgcatcactgctacccgatcgtatgtatttttctggtgaaccggcacagatcgctgagattaaacgactggccagcggtgcagtcacaccgctttatcgccgcgccacaaatgaaggtattcagctgtttctggccggaagtgccggacttctgcagaccactgaagatgtgcggtttgaaccatgccccggactgacggctgccgggcgtggcgttgtatcgccggagaatatcgcgttcacccgctggctgacacacctgcaggacggtgtacttctggatgagcaaaactgcctgatgctgcatgaactctggctgcagagcggtactggccggcgtcgctgggaagaattaccggatgatgccagggaaagcattaccgctcttttcaccccaaaaagaggtgactggtgcgacatctggagtaacgaggatgtatctgtgtggtggaaccgtctgtgtgacaacgtcctgccggaaaaaaccatgccgtttgacctgctgacggttctgtccactcgcctggatgttgaagtgaatggctttaacggtggtgttctgaacggtgttccttctgcatatcactggtatacggaacagtatggcgtgaagtggccttgtgggtatgaggtgaatatcagcagtcagggagacaacttcattcaggttgatttcgacacgccgtggtgtcagccggaaagcgacgttattgcagtattaagccgccgtttcagttgcatgctggagcactggtacgccgggcagggctgcaatttctgtggctggcagcgatatgagcgtggagagcttgttgatgtgctgtggggggaactggaatggtcttccccgacagatgatgatgagctgccggaagtcaccgcgccggagtggatagtcgacaaggtggcgcattacggtggatgaagtatgacggagacgggcgggcaaccgcccgtttcttttccggtaaaggatgtcgccgggctcctctttttactgcgccggctgacgcggcgcggcaggaacgctgcctgtggtcagtgtcccgcgtccggccgggcacgggacgggcgcttttaccgctcccggctggcatcggtgacagtgtacgccagcccgtcgcccttttctgatgaacgcccttcaagccgctttcgcggcatattctcgccgtcaaaaagacgacggctgcgatattccacggtcggcctgacccgttaccggacgcggtgaacagcccacaggccgcggggaacgggcgccacaggggcgccctcccggtgccctctgtaagagaaggagtgctgttatgtcccgttttatccagggtgactgcgtgcgtgttatggccacgattccgggcaatggtgtcgatttcatcctcaccgacccgccatatctcgtcggtttccgtgaccgtcaggggcgtaccatcgccggcgataaaaccgatgaatggctgcaaccggcctgtaatgaaatgtaccgcgtgctgaaaaaagatgcgctgatggtgagcttctatggctggaaccgcgtcgatcgctttatggccgcctggaaaaatgcgggattcagcgtggttggccacctggtgtttaccaaaacctacacttcgaaggccgcatatgtgggctatcgccacgaatgcgcttacatcctggcaaaagggcgtccggcgctgcctcagaagccattgcccgacgtgctgggctggaaatattcaggcaatcgtcatcacccgacggaaaagcctgttaccagcctgcaaccactgattgagagcttcacacacccgaacgcgattgtgctggacccgtttgcaggcagcggctcaacctgtgtggccgcccttcagtccggacgccggtatatcggtatcgagctgcttgaacagtatcaccgtgccggacagcaacgtctggctgccgtacagcgggccatgcagcagggggccgcaaatgatgactggtttatgccggaggctgcgtaaatgaactatgccggacatgaaaaacttcgcgccgacgtggcggaggtggccaacaccatgtgtgaccttcgggccaggctgaacgatatggagcatcgctgtcgctttgattccgatgtgcttgttgaacgcctggcacgccagacgctgtatcgcgccaatcgcctgttcatggaggcgtataccgaaattctggaactggatgcgtgctttaaagattgagaaggagacgagaatgtacggaacatgcgaaacgctatgccgggagctggcagcaaagtatccgggatatacaccgctgatgctggttatctggtccccggaagagattcaggccctcgctgacggaatggatatttccctgtccgatcctgaaatcaggaccgtcctggcgcgcctggaggacatcccggaagaccagcgaattgagtccggtatttcttctgccgcggcgatggagattatcagcaacgtgagcgaaaaccgccaggtgaccgtcccggctgaactgctggcgtccctgattcagaccgccgaacaggcactgtggaaacgtgaatgggccgcccgtgattacggtctcgccgtcccggaatgcgttacccgccgtcaggcggtggttaatcaggcccgcatcctgctgaaaaacaacacacacgaaaacggctgatgttatcgccgcctgcgggcggcgatacagggagaacgattaatcatgaacgaaaacacaacgctgaacgcactgatttgtcgtcacgcccgtaacctgctgctggcgcagggctggccggaagagacggatgtcgaccagcgtaacccgaagtatccgggctggatcagcatttatgttctgctggatgcgccccggctggcgacgttactcgttaaccgccacggcggcgtactgccgccgcacctggcctccgccattcagaaactgaccggaaccggagcggaacttgttctgtccggcagtcagtggcagtcgctgccggtgcttccggcagacggaacgcaggtgtcttttccgtatgccggtgaatggctgaccgaagacgaaatcagggctgtacttgcggcggtgcgcgatgcggtacgcagtgtcagttgccgggtggcagaagatacgcggcgtatccgggcggcgctgaccaccaccggtcagacgttactgacccgccagacgcgccgctttcgcctggtcgtgaaggaaagcgatcacccctgctggctcgatgaggacgacgaaaacctgcccgtggtgctcgatgccatcctgaaccggggcgcacgtttttcggcggtggaaatgtatctggtcagcgattgtattgaacatatcctgtccagtgggctggcctgcgatgtgctgcgtataccggatgaaccgccccgccggtggtttgaccgtggtgttctgcgggaggtggtccgggaagcccggaacgaaatccgcagcatggcggatgccctggcaaaaatccggaaatgatgacgttggcggggtaaatccccgcctttttcctgccggtccccggacagagcacaaaggaagtcgccgctggctccgctttacccggccatgcagggcatggccttgtggtttttcagttatgtggcctcagcgtcgtgtgcgggcggtgccgtgcctccatcttagccgggctggcgttgatgcaagggtacgcttcgccgctgcggtcacccggtccctccttcccgtctgccgtgattttccggtcgttcgcccgctcaggtttcgcggcctcaccctgcaactcccgtcagccgtgtgcgtcaggctgcggcttcccttgcgccctgtgcatccccgccttatcgcccggcttttctggaggcacggcaccgcccggtgtcgcggaatatgtgaacaacggaggaaaacatcatgcaatatgcgaaacctgtcactctgaatgttgaagagtgcgaccgtctctcctttctgccttacctgtttggcaacgattttctgtatgccgaggcgtatgtgtacgcgctggcgcaaaaaatgatgccggaatatcagggaggcttctggcacttcatccgcctgccggacggtggcggttacatgatgccggatggcgaccgtttccacatggtgaacggtgcaaactggtttgaccgtaccgtgagtgctgatgcctgcggcatcattctgacttcccttgtgattaaccgccagttgtggctgtaccacgacagcggtgatgcaggactgacccagctttaccggatgcgcgatgcgcagttgtggcgtcacatcgaatttcaccctgaatgcaacgcgatttacgcggcactggactgattaacggacggggcggcaatgccgcccctgtaaaggagacgagaacatgtactgtactgttaaagaaatcatccgcgatgtactggatacagacgtgccggacagtgaatgcgtttttgccgtggtgctgacccgtggggatgtgcgccacatagcccaggactggaacctgtcagacgatgagctggaaaccgtcatgcagcggctggacgatgcctttgaatatggtgcggatgtcagcattgttcacgacgttgttcgtgagttgatggaagaaaagcgtgccagccgtcaggtgacagttccggcggtgatgctggaaaaagtgatggcgctggcaggcagtgaaatgaagcgcctgtatgccgtcgggagtgagaacgggggcgacggtgatgcgttcgtcagggaggaacgcgaagcaatggacgttgtgttacaggcgctggacggggagcacatgtcatgaatatcagcacagaaacccgcgaaattctgcgcaattacaaagccgtgattaatgcgcgacgtcgtgaaatggggcagaaaccgctcaccaccgcgcagattgttgatgaaatctgcgattttgtggcgaatcagcaggctgttttcctgggcggtcactacatcttacagggcagcagaaacaggtgatacagggctggcggtggaggccgcctgtcagcccgcgcgaaaacccctggcaggctgacgcctgccggaagggaagcgggccacgctgacgcgtcgtccgttacccttcctgtttgtgatgtgtccggaatgtttttttctgatgttatttttctgtggttaccgtgcctgttactgttcttcttctttttcctcttcctcttcctcctcttctttccgttcctctcctgcttatggcttttccgggcgtccccctggcggggcgggctgtcgtgaacggagccagcgaagctgtctccgccctggcgggcttccatccctgacgcgaaaccctggcttgcagcgaccgttccggtcgcgcagcctctgtcgcgccgtggcctgcgctcccggcatcccggcaaaaggccgccgggatgtaaggggcaacgccgtttcgcaaaccgcgcttcacgtcgttgcggcgggtccctgctcattgcctgcagggtgccacacacccgtatgagtccctgtcgccgggagctgatacagccacaacctgccgcactgactgtccagggtaaatgaacagcccacaaaattttttacccagaacccggtaaaaaattttgcgttctgcccaggacaggtgtgtcaggccgtggcagtgatgccccttgcggcgaaggttctcaaacgggtgaagttcataccacagggaatacagcagcaggttcccgcgaaacgtcaaaaccgcggctcccgaaactcaacgggtgatgttctttaaaaatcaggatttatttcaggctccggcaatacgcatttatgtgttctgtcagtcatccggctgacaggtaatgagaacgcaggaacagaaggaggaaaacaccggaaagcgtcagatgcagatatgaaaaaagcaggtcagggacctgcttaatccacgccgtaagaattgtgcgaccaattttgacggcattgttaaccaatttgtcataaggaatccatttatgactgtaagcattgtttcaccttccgcagcggctgtaaagccccgccgtcatccccgtttcagacgcgaagacatccccgctccggaaattgaccccgtgctgaaagccttcgggcgacacatagcccggagttttcaccgggggcgtggtgtacacatccccgccatgaaaaacacggctttcgggcaggtgctccgcacactcgaactgaaacgcgcttttaactgatgaggtgagccgccccgcgaggggcggcaacagacggaaggagaacattttatgacatcagcagcaatcaccatgaccgccccggaagccgccagccctgtgcagatgtaccgcgcgacctactcaccggatgacaacaaactgcgcctgtatgccgtgtcacgtcttgacccggagacgtataaaaaagtgcatgatgccggttttcgctgggcaccaaaacaggcgctgtttgtcgcgccggcctggacaccgggccgggaagacgtgctcctctcacttgccggagagattgaggatgaagacagcacgctcgctgaacgtcaggaagcacgggcggagcggtttaccggatacagcggaaagcgggccagtgaatccgcacaggcacttgatgaagtggaaagactggccgcgatgatcccgcccggtcagcccattcttgtggggcatcacagcgaacgccgcgcccgtcgtgatgcgcagcgtattgaaaacggcatgaaacgtgccgtgatgctctttgaacgtgcggaatactgggaagaacgggggcggtcagcactgcttcacgcgaagtataaagaacgtccggacgttcgctggcgtcgtatcaaaaaaatcgaagctgatttgcgcaaggctgaaaagaccatcgcgcagtcgcagaaatatctgacgatgtggcgggctgaatcgctggatctgaatatggcaaaactcatcagcagtcatgaccatatcagcgcctgtttcccgctggatacgtatccgcgcccggcagaaaaaagccagtatgaagggagccggtcattatggtcggccctggatgatgacatcatcaccacggagcaggcccgcgaaattgcgatccgctgtcatgaacggcagattcagcatcagcaacgctgggttaaccactatcagaaccgcctgaactatgagcgtgccatgctggacgaaagcggcggcgtggttacccggacacaggattttgagccgggcggacaggttttcagccggggcgagtggctgaccatcatccgcgtgaacaaaagcaacggggcggtgagttcagtcacaacgccgaattacagttttctcgggtacagcggcacgatgaaagtgacgcccgatcgcatcacggactacaaagcaccatcggcagaagaggctgccgtcgccagccaggccgcgaagcgtccgccggtagtcaactatccgggggaaggtttccgggaaatgacaaaggcacagtgggccgccctgccccgggactgtaaggccgtgcgcagtgtggcagaagcagaagaccacggggcataccgctaccgccgcacaatggacaataatttccgtctggtgaatgtgtatatcaccgacatgaaaattacggaaatcccacagaaataaggtatatccccccgggaaatccccgggggatgacggagataatgacatgcacagtcagttaaaagaacgtatccggctgatgcgcgcaaggctggataacgccgcgccggttgctgaaatccgggctgaatctcagctttttgtgactcctgccccggtctgtgatcgcctggtgacgctggcggagatcagcaaccgtgatcacattctggaaccctctgccggcaccggggccatactgcgggcgattcgggataccgcaccggaggccatgtgtgatgcggtggaaatcaacagcgggctggtccggtatctgcgggaaaattttaacggtgtcagggttcagtgtggcgacttcatggaatggcagccggtgcagtattacagccgggttatcattaatccgccgttcagccacgggcaggatatccggcatatcctgcgggccttttccctgttgcgtccgggtggcgtgctggtcgccgtctgtctgaacgggccgcgccagcaggagaagctgttaccgttttctgacgtccgcgaggagctgccacgcggcacgtttgcttataccgatgttccgacgatgattattcgtctgcgtgcctgatgactccgggcaggcgggaggataaatgcccgtctgcccgcgccgggaaaagaccgcgcgccggtggcgctgaaaggggccgcgctcacgcgccgccccttacattacgcggacattctgctgtgggcttctgtcttttcagacctgtcatttgtctgttactgatgatgttgttgttcatgctactgctactgctactgctactgctactgctactgctactgttcttcttttttctgctgctctgattactgtctgttttgttgttctcctgcttatgccttttccgggcgtccccctggcggggcgggctgtcgtgaacggagccagcggagctgtctccgccctggcgggcttccatccctgacgcgaaacccgggcttgcagcgaccgttccggtcgcgccgcctctgtcgcgccgtggcctgcgctcccggcatcccggcaaaaggccgccgggatgtaaggggcaacgccgtttcgcaaaccgcgcttcacgtcgttgcggcgggtgcctgcccgttgttgtgtccggtgccattcacctgtttaagcccctgtcgccgggggcaaagacagccacaaccgtctccgccagtccaggggtgaaatgcacatcccgcaaaactttttgcccaaaagcaggcaaaaagttttgcggtctgcccccggacagtcgtttccggccgtggcagtgatgccccttgcggcgaaggttctcaaaaaggtgatggtgaataccggagggaacaaaaggcaggtccccgcaaaacgtcaaaaccgcggctcccgaaactcaaaagatgatgggggctgaaaacatcaacagaaggagacacatcatggcagttcgtggcattaacaaggtcatcctcgtaggacgcctgggaaaagatccggaagtccgttacatccccaacgggggcgcagtggcaaacctgcaggtggccacgtcagaaagctggcgtgacaaacagacgggggagatgcgggagcagacagaatggcatcgcgtggtgctgttcggcaagctcgcggaagtggcaggtgaatatctgcgcaagggcgcgcaggtctacatcgaaggtcagcttcgcacccgtagctgggaggataacggtatcacccgttacgtcaccgaaattcttgttaagaccacgggcaccatgcagatgctggtacgtgccgcaggtgctcagactcagccggaagaggggcaacagttcagcggtcagcctcagccgcaaccgccggagggtgacgattacgggttttcagacgatatcccgttctgaacgactgactgtgacaaccgccccgtcctgtgcggggcatcaccggagagatgaggatgagcgaatatttcagaatacttcagggactgcctgacggtccttttacccgcaaacatgccgaagccgttgccgcacagtaccggaacgtctttatcgagaatgaccacggcgaacagtttcgcctggttgtccgtaataacggtgcaatggtctggcgtacctggaattttgaggacggtgccgggtactggatgaaccatgtcatccgtgatttcgggattattaagtaagagaggtgccggacgggaacgcgtccggcagacaatcattattaccgttttgggaggtactaactatgtcagttacagagtctaaggcaaaaacggagcgtaaatccagccgtaaacctgcaaaaacgcaggaaacagtcctgtcggccctgctggcgcagacggaggaagtgagcgtgccgctggcctcgctgattaagtcaccgctgaatgtgcgcacggtgccgtattctgcggagtccgtcagcgaactggcggactccattaaaggtgtcggcctgttacagaatctggttgttcatgccctgccaggtgaccgttacggtgtcgccgcaggtggtcgccgactggcagcactcaacatgctggcagagcgtgacatcattccggctgactggcctgtccgtgtgaaggtcattccgcaggagctggcgactgccgcatcgatgaccgagaacggtcatcgtcgggatatgcaccctgccgaacagattgccggattccgtgcaatggcgcaggaaggcaaaacacctgcacaaatcggtgatttgctgggttattcgccccgccacgttcagcgaatgctgaaactggcagaccttgcgcctgtcatcctcgatgcgctggcagaagaccgcatcaccaccgagcactgtcaggcgctggcgctggagaacgacaccgcgcgtcaggtgcaggtgtttgaagccgcctgtcagtcgggatggggcggtaaaccggaagtacagaccattcgtcgtctggtgaccgaaagtgaagtggcggtggcagggaacagtaaattccgcttcgtgggggctgataccttctcgccagatgaactgcgcaccgatttgttcagtgacgacgaaggtggctatgtggactgcgtggcgctcgatgccgccctgctggaaaaactccaggctgtcgccgaacaccttcgggaagccgaaggctgggaatggtgcgccggacgtatggagcctgttggtttctgccgtgaggatgccggaacataccgcagtctgccggagccggaagcggtgctgacggaggcagaagaagaacgcctgaacgaactgatggcacgttacgatgcgctggaaaaccagtgtgaggaatccgacctgctggaagccgaaatgaagctgatgcgctgcatggcgaaggtcagggcgtggacgccggagatgcgtgccggaagtggcgtggtggtgtcctggcgttatggcaacgtgtgtgtccagcgtggtgtgcagttgcgcagtgaggatgatgtggctgataacgattaccgcacggaacaggtgcaggagaaagcctcagtggaggaaatcagtctgccgctgctgacgaaaatgtcctcagagcgcacgctggcagtccaggcggcactgatgcagcaatcagacaaatccctggcacttctggcatggacactctgtctgaatgtatttggcagtggagcgtacagcaatcccgccagaatccgcctggaatgtgagcattattcgctgaccagcgatgcgccgtcagggaaggaaggtgccgcattcatggcgatgatggcagaaaaagcccgtcttgccgccctgctgccggatggatgggcacgggatatgacgacgttcctgtcactcagtcaggaggtgctgttatcactgctcagtttctgcaccgcgtgcagtatccacggtgtccagacccgtgagtatggtcacacgtcacgcagtccgctggacacgctggagagcgccatcggctttcacatgcgcgactggtggcagccgacgaaagcaaactttttcggacacctgaaaaagccgcagattatcgcagccctgaatgaggcaggactatccggtgccgcacgggacgcggagaagatgaagaaaggcgatgcggctgaacatgcagagcaccatatgaaagacaaccgctgggtgcctggctggatgtgtgcaccacgcccacagacggatgccactgaacgcaccgataacctggctgatgccgcctgatgaacaaccacaccgccccgccggagacggggcggcagcaagggagataccgtgatgaaaactgaactgactctgaatgtattacataccatgaacgcacaggaatatgaagatatccgggctgccggaagtgatgcacgccgtgagctgacacacgccgtgatgcgggagctggatgcgccggacaactggacgatgaacggcgagtacggcagcgagtttggcggctttttccccgtccaggtccgtttcacgcctgcccacgaacgttttcacctggcgttatgttcaccgggcgatgtctcccaggtctgggtgctggttctggtgaatgccggtggtgagccgtttgcggtggttcaggtacagcggcggtttgcaccggaagccgtcagccattcactggcactggcggcgtcactggatacgcagggatacagcgttaacgacatcatccatatcctgatggcggaaggaggtcaggtatgagcgcacgttcacaggcactggttcccctcagcacagagcaacaggccgcatggcgggcagtggcagagacggaaaaacgccgcaatcagggaaacacgctggcggaatatccgtatgcgggggcgtttttccgctgtctgaacggaagccgcaggatatcgctgtctgacctgcgatttttcatgccgtccctgaccgcagaagaactgcacggaaaccgtcttcagtggttgtatgccatcgatgtgctgattgaaacacagggcgaggtctgcctccttccccttcccggtgatgcagcagaacgcttgttcccgtcggtgcggttttgtgtcagggaacgcagtcgccataaatccgcgctggtcatgcagaagtacagccgccagcaggcgagggaggcagagcagaaagcccgtgcgtaccaggcgctggtcgcccaggctgaaatcgaactggcgttccattcaccggaaacagtcggaagctggtatgcacgctggagtgatcgggtggcagagcatgacctggaaaccctgttctggcagtggggcgagcgttttccgtcactggccggaatggaacgctggcagtggcaggatatgccattctggcaggttatcgcggaagccagtctggcagcaaaggaggccggtcatgctgtccgtgagatggagcggtggatggtgccgaacaaactccgggaggtgcgtgatgcggcaacaatcacacggattgcccgtaaacagcctgaatgagcgggttattttcaggaaaagtgaatgtggtcagcgtgctggtatatgggctatgatgtgcccggcgcttgaggctttctgcctcatgacgtgaaggtggtttgttaccgtgttgtgtggcagaaggacaaaagccccgtagttaatttttcattaacccacgaggcccctgcatgcttagacaacatcaggatagcctcttaccgcgctttgcgcaaggagaagaaggccatgaaactaccacgcagctctcttgtctggtgtgtgttgatagtgtgtctcacactgttgatattcacttatctgacacgaaaatcgctgtgcgagattcgttacagagacggatacagggaggtggcggctttcatggcttacgaatccggtaagtagcaacctggaggcgggcgcaggcccgccttttcagggctgatgctggtctgactgcactgaagcgcctttataaaggggctgctggttcgccggtggcccctttctccttgctggcattgtacgggcatgaacagcctggcgacgcgggaaaaagcagacgttcagggaatatattgctcagatgtcgattgccgggctgcgtgaagagcccgcacaggactggttatctttgcataaacggctggccagtgatggtctgtatatcacgatgcaggaaggggaactggtggtgaaggatggctgggacagagcgcgggaaggtgttgcactcagttcgttcggaccgttatggacagctgaaaaactggggcggaaactgggggaatatcagcctgtaccgacagatattttcagtcaggtggggacacccggtcgttatgatccggaagccataaacgttgatatccggccggaaaaagtggcagaaacggagagtctgaaacagtacgcctgccgtcattttgccgaacgcttaccggaaatggcgagaaatggtgagctggaaagttgcctggatgtgcacagaactctggcaacggctggattatggatggggatccagcacgggcatctggtactgcatgatggatttgataaacaacagacaccagtacgtgcagacagtgtgtggccgttaatgacgctggattatatgcaggatctggatggtggatggcagcctgtaccgaaggatatttttactcaggttatacccggagaacggttccggggacgtaatcttggtactcaggctgtcagtgattacgaatggtatcgtatgcggatggggacaggtccacagggagcaataaagcgcgaactgttttctgataaggaaagtctgtgggggtacacaactgttcagtgtgagtcgttgattgaagatatgatcgcgggcgggaatttcagctggcaggcgtgccatgagatgtttgcgcgtaaagggcttatgttgcagaaacagcatcatggtcttgtgattgtggatgcgtttaatcatgagctcacaccagtgaaggccagcagtatccacccggatttgacgttatccagggctgagccgcaggcagggccatttgagattgcaggtgcagatatatttgaacgggtgaagcctgaatgtcgctacaatccggaacttgctgccagcgatgaagtggagcccggcttccggcgcgatcctgtactgcgtcgtgaacgccgtgaagcccgtgcagctgcgcgggaagatttgcgcgcgcgttatcttgcatggaaggagcactggcgtaaacccgacttacgttacggagaacggttacgggaaattcatgctgcctgccgtcggcgcaaggcgtatatccgtgtgcagttccgggatccacaattgcgtaagctgcattaccatattgcggaagtgcagcgtatgcaggcgctgatcaggctgaaggagagtgtgaaggaagagcggttgtcactgattgaggagggtaagtggtatcctttgtcctaccggcagtgggtggagcaacaggcggtacagggagacagagctgcattatcacagttacgtggctgggattatcgtgatcgtcgcaaagacaagcgacgaacaacgaatgccgaccgctgcgtgattctctgtgaaccgggaggaactccactttatgaagacactggcgttctcgaagcccgtctgcagaaagatggcagtgtgcgttttcgtgatcggaggaatggcgagttagtctgtgtggattatggggaccgtgtggtgttctaccatcatcaggacagaaatgaactggtggataagctgaatctgattgctcctgtattgtttgatcgtgagccaggaatgggttttgaaccggaaggctcatatcaacagtttaatgatgtatttgcggaaatggtggcctggcataatgcagctggaataaccggaaatggacactttgtaatcagccgcccggatgtggatttacatcgtcagcgtagtgaacagtactaccacgaatatatcaggcaacagaaaagcatatccggggggcatggcgcatcttatgctccagttcaggataatgagtggacgccaccatcacctggaatgtagggatgaggagtggatattaaaaatcttaacttgtattagttaagattttctttgctctgacagagctatggtactgagatctatatgggttgaggagcaatatatgggggtaaagaaaatcgttatactggctattttagtcagctttgtggcgggatgtgcgccattacatccttcaaattgccataaaactacagccctgggtagttgcagttcaggacgttgggatgatcaggatgaatggggggagcaggcacggggaatcagggatgcaattaatgctaaacttgatgatccgcaaaaatggaaaaggaaaaaatgcaggttgcatatggaattctcccgggatggcacggcgttaaaaatatcaaccagtaatggcgataaagcctattgcgaagcgataaagtcagcagcccataaagctaaattcccggccttcaacaatccggaagtttatagagattttcaaaaatccggctttgacatgcgcggttagctacacgacatatctgtagggctaacagaagactgtcaggtcggctgattactggaacctgaggtactttgcctcaggttatgttgacatactcaaaaaaagattcttacattatcccggtaacggcgtccttcatcggcctgtccgttaaactcaggctacctcacacctcacacctcacacctcacacctcacacctcacacctcacacctcacaacagcgggtctggacagaaagcggctcttgatgtggattatcgcatggtgtgggctttcagcggcatggtgactggaaagtaacgatattgcatctgtggcaacgaaaattgcagagttggtactctttgaactgcataagtaagcagaaaggtaaggttatgctttgcgattgaaattcagccttaacgtacaataattttcgatatccaaactgcccccctataacagcaaaaggtcccacaagacgctcgtggaatatattttaaaagagaacaaaaattgcaatatgtggtggctccatacagaggattgacaacattcccatgctaattgttaagattcaaattgaagtatatctatctgtcatttttgcaaatgacatgcggtagcataacgttccgggggctcctgtgccgtcatgcgtgacgacattgatcagccaataatggcacgtgaccacagccagatacggccagccttcatccgtacgtaaatatgtgatgtctcccgcccacttctggttcgggccactggcgtaaaaatcctgctccagcagattttctgacacaggctggctgtgtgcgcggtaacagaccggactgaaattccaggaagcttttgccctcagtccgtgacggcgcaggctttccgtcacggtttttactttaaaatggtaaccctgggcacgcagttcatccatcaggcgttgtgcatgaccgggtaaaagcaacgaggacaacgctgtcgcagtgctgacggaactgccgacgtgtacttatccttatccgccagtgatataagacggtaattcaccatttggattgtccgctccacccaacatgttgtttccttgaggttctcacaccagaaaggacatcagcatgctgagcagagaggacttttacatgataaagcaaatgcgccagcaaggtgcgtatattgttgatattgcgactcagattggttgctctgaacgaacggtcagacgttacctgaaatacccagaacctccggccagaaaaacacgccacaaaatggccgaaatggactatatcgacatgcgtctggctgagaatgtctggaacggcgaagttatcctggcggaaatcaaagcgatgggttataccggtggccgttccatgttgcttcgccagttcaggaagacaccggagcagcgctttacgcaggaacacagtctgttcttccggttgctgaaccgtcgatatgaaaaagcgagcattgtgctgacgtccaataaagggttcgccgactgggggagagatgttcggtgataacgtgctggcaaaatattcacccaacgcattgagcgtaataatctgacgctacgcacccgcattaagcggttgactcgtaaaaccatctgcttctcacgctcagttgagatccacgaaaaagtgatcggagcgtttatcgaaaaacacatgttctactaattggatgcaccaccgaatacattaatttatataacaacatcaaaatacattttaggttgtcgctaatcaaaaattattaagtgttacataattagagggtatagatatgattcatcctggctcttctttagataaagcaattaacaatacaagagttaaaaatgttagtactgatgttaaacatggccaaattcaagagagaaaaaggaactttatctataaaaaaaatgatgatatctcatccagatttaaactttacagttcgctcgtaaagcagaaaaatgcgacagaagatgttgttttaataggcaaaatgattttagatgaagttagaagttacagaactatacataatgatcgaaatatcgtaagtaactcaggaaactggaaaacatcttttttatgtaatcttgctagactactatatagcatatttaatggtagtaactatttttgttcccgagagggtgaaaataattcatcccccagttctactctacttactatacatcagcctgaaaagcaggaactattacaacaaaagagtatcaaacatttaccaacaagtaataacatcgacggatacattaaaataagaaaaacaagaggcgctgaagatcaaacaacaactatcactcaaagtttgataattaatgagttgttaaatggagttgatagaaataccatcccttttcagaaaataagtgagctcaatgatatcatacattcatatgaaaatatgcaaattaaaaatagtcgaaaaggtatagaaatacttgttaagcagggagagctgttatcatcattaataaatgataataaaggaaataaacaattatcagacaatgcatctaaaataataaacttattgggtatagagtatcagtcacataaagtagacatagagccatttatacatgcagtatgggttgctggcgcacctcctgataatacattttcatatataacggcatttttaaatacatataaagattatacctacctgctctggattgatcctaatgcctttggtgcggccaagtttagtgggattttaaaaaatatagcgatgaattatgcaattatgcgtttgagaagaacgaatccacatttagcggaagaaatgaatgaagtgatattaaaaatacaaaacatacaaaatgaaactatagaatttaaggaaacaagagaaagattgaaggaacttgaaaatagatataaatcattaacgagtgaaactaaagaaaaattcaatgttttttttcttgagtcaatgataggtatgcaagacaactattttacatattgtatatcaaatggaatatcaaatactgatgatatatccagacttgactttttaactaacgttttaaaactttcaccagaagttcaaaatgactttaaatctacagtagagaaaaacaaaagagatatagacttattaaaaaatacaatatctcaaaaatttggggatagatttcaactgagagatattaacacattggagtcatttaaaaaaccacaagattattttttttatcaacaagagatgctattaagatggaactacgccgctgcatcagatcaggtaagaattaatatattgaaagagtatggagggatttataccgatacagatattcttcctgcatattcagataaagtatcacagataataaatgaaaaaagtgatgataagaggttttttgaagatttaaaactaagaaggattatatcagaatctattctgtctctgataaaaggggaaaagtactcaattaaacatgatggattagatgaaacaacactaaatcagttaaataacatattgagtgaaatagaaaaactgacgatagatgattattttaaacccgttgagacaaaagttgtcagagatacatttaaaatttttaaaagatatcaaaaatggacagaaaacacctggaatattagagggaataataatttcatgttaactcacaagggaagtaaatgtattgattttattctatcaggacagaaaaaacagtatttagaactccaacgcatcagagataatataagttataataatctattttatactacagaggatctaaagtctttaaataatgtggcaataggaggaatacctgcaaagaaatatttagaacacggtttgttttctgaatatagacaggacggtacaattccttatgtggttagcactttaaatatatctggcccagacatgattatgcgacaaatgaaaaaatactataaatctcttgggcgcataggtgaagtgcatattaaagataataaattgagtgatgttaattttttgggtgtatatgcaagttcaaataaagacaataaaagttttaactggctaaatccagtgagtgttggtattaatgatattacaccagatgatgaaagctcatgggctgtcagaaataatgatataaataaaattctattcgaaaaaataaactgccatgtacccgaaaaactacctacctccctatactatgaaatcgattcgcggtctttttttcaggggtgggataataaaagcataaagcatgttacagagattaataaagacctcatcaaagatattaatttattattaacatcgtctaatattgatgttaaacttttaataaaactggatcgtgaattatatgcgattagcagtaaaatagataatccgttggccttgcgctctataagaaccttacagctacaattagctaattacgtaacttcgaatacatttgaacctgaaaacacaattaattttatttatgatttttatagaaaaaaacaagatgacttactcagcgcaataaaattattttcgcgtaatgatgccgatacaaaaattattgtctggtacaattccgtaatggaaaaaaatgtgtttctccgagaggttatatcatgtgttctacgaagtaaaaaagtagatagttatataaatgaaaacaaaaaaaacttatctaaggaggatgccggagctttaagagattatgcaaaattaaaaatgaaagaactattttcgatgttagatgatgatggttataaaaaaatcataactacaaatgcatatattaaagagagggataaactatcaggcattatatacaacatcgaaaattcgattatatcgggtcatgaatcatttgatataatacgaagcaatcaacatgagtggggggatttatcaacggtagagcaatttaaaaaatttgagttttatgtgaaaagtgaattatcttcggctaagtcaattttcgatgatataaaaaacaaatatataacagatcctgaaacaaaacgaaacgtactctaccatcagttagatagtgatattaaagagcgaatagcatttctcgatatatcccactatgcatatccgggtagtttattagaaaaattacaattaagtggctacgttttttctgatatcaacataattgcagaatacttattggctagttacggagtttctggacattattctcacggcgtggtatatccagctccatctgataaattacttgagctattaagaagacatacaaagagcaattctgagtggatagaaaaaataaccccatatgtttatgatatattatccgataatgtatccaacgtcttgcgcccccctttatcagaagaacagaaaaaaatattgaatgatataaaattagaaattagtaaatctgtatcagaacagtatttcatgaagttgacagagcaaaaatcatcagttattggtattaaatattctgttgattttgacagatacaatgagaatttgtttttgtctttacctataaatcaaaatttaacgctgccttttatgtatcgctacttcgagatgctatatgacattcacattggaataatagaaaacaaggcaaacagggagtttatatatagtaagttttcatctttaaacctggattttttgattaatgacgagagagttttgaatcttgaaggtttaataaaaaaatataaatatttatcgctgagtgaaatacatagaactttaacaaatagtacttcatttgcagatatttctataccattattgcagaccatatgtcccagcataacaacaataataaaaaaaacagaatattatgggcatcagttaacaaatgctatgactgttgcttcagtggttaaaccatatgactttagcaatcttggtgccataaatagtatagataaatccgtttctgatgtgcctgcattgcatacaattgttgaacaagcaaaatataatttactttcatggaatgatttttataacactcatgcgtcaatatgggatacaatagcaagacagcataaaagtacaaatatcgaatttcacccacaaagtcttctttttgatagagattcgaaaggaaagtgccttggtttatctcttctgtatcttgatacaggggggtacggaggcggatatcaaaaactgaggcacaatattgacactgccagcacattatatcaaacaaaatacaatgacaatctaaaattatctaaccgtgatgatttctttttaagaaaaacacagcgtatcattacaatgtccaatgagttaggtaataacaggttaaaaaatgcacagttagaggttctggaattgaaagaccctatactaactgaaggcatattataccagcgtcgtatatcatctcttttaataacaacagaatatcattcacttgcattacaacaaatatcttctttttggagagtaactgatcctaattttggtcattgtgactttcattccttagcacaggctttaacgtttataaaaaatataacgagcaatcgtaacttttcatctttatatggaagtggcattgttaaaatttacttcagtgaatctcttaataattggaagtatattaagctcccccttgttcagactggttctttgttaagagacatatatttaacaaccccagaaaaattatccacaagcgggggttcattaaatattatggggcatctcgtgcctgtcagttttatttatgatatcggaggggttattaatggtaacagaataagtgaaagtacagatgtgaaaaataaaattaggagcttaaaaataaatggggatattttacaacattatataaatacgcattatttgtcagaggagcaaactcagaagataaaagatattgtggattttttaggtattcaggataacacaataaaagttaagcttgaaagtgatattaaacctataagtgaaatccaacagccccttcattccattctttcacggcagaaagaacacgtaaagaatttactatctggattgcttgatgagttttcaaataagttaagaaagcaaggtctttcacttaaaacaaatgttctttcagttaataacttcaaagaatcaaagataaatagtgatacagtggaggttacagtaacagatctgcaaggaagactttatcgtgttgatatagatacaagagttattggcttaacttttaaagaggggataaatagtttatccgaagcactcgaacacatgaatatcgatgcgattatgtctgttattggcttggttcaatatgcacgaatgataaaaatgaatgacaatattagtgcaatagatcatgcaggagcagtatcagatataaaaaatattgtagacaaatttttaggcggaattttgactcttactaataatcgcgtatataatcctggcggtgtatctggtgcctcgcttgaaggatttatatcttctgggttggaggtgtgtgcttcaagaatgggtggcaccgcagggcgttatcttagcaatgtggcaaaagtaattaaattacctttgctagatataggcataaatatttggtcattatatgattcttcattaaatcatgctaaagccaccacacaaattgaatatatatcaacagcaatagatgtatctttttcatctataaatacagctttgtcaataggcgcaatcgcatatcctcctttggcaatagctatagttccgataactattttttctcatgaagtaaaaaactatgctgtttatgtgaatcaaattaatgagcgccataagttatggctcgaagctgaaaagtatctggacaatggaagtgcaaaggttctaagcattaacaaagccacaggcataatcgatttatcaaataatcaggtgttaggtaatatttatttagatatgagagaaaatcctccaatattacacggtgagaaatcatataatagcggaaagaatattggtagtcatcctgatatgactgacagagagattatggagtctagagcatacaattttgcatgcacaaaactctcagatgcaggtgaacccgatattttcggttggggagataaggaaatatgtaattcaatggaattatcagaatcacaattagctaatgggtattctaaccgccaatggccttctcagattccagttattccagaaggaatttataatacagtatatcttggatatggagaaacattgcgagctaatactgaagttacattgagtagcactggttacttttacgagattgcaagggcatatactgatgatgaactatctgagccattattaacagtatgtaaccaacatagtcatgttattggtggaaaagaaccattaacaattattattcccgctattgaacatggtatgcttggctctaatctacatatgattgaacgttttaaaaactataatttctcgatatcaggagggaagggagggataaaattaatggttggtggtattggtgattacaacatagaatgtacccccggtgttagaaatattatatcgtttgaacaattatcacgtgacttcaatctggatttggatttatcagatgggaggaaacaaaattttaattttcatcatccctcaggtttttattcaggaaaagttatgagcataacgcaaaagggtataaatgcggttgttggtactaaactgggatatgataagattcgtggtaataatcttgataataccttttctcttgggagtggaggaggtgttatatattctggaggagggagcaatacctatttcgttcccgccacactacaggataatttacacatatatatatcagaaaaatcaaatggcaatcatattatattaggtgatatgcactctcgcctatctattgaatgccactttagtaataatgaaagagagtttataaagatgggctactataatggatgtgatgtgattttagaaagtgacactatacaaaaaataaaatcatttgcaaaaaatataacaatacagacagcggatggagttatggcaaattgggatgataaactaaatactctgtctgtttattcaatagatatgattgcatggagggataaaaataaaactgcaaaagaaccgttaccagttgatgtaatccagttaactaattggaggatgcataacacatgctctttattttatgataaatatcaagttgatattgaagccaataagttaacgtatacagtcttatttcctgatacggagttacccgttcagctcaattataccagtattatttatggtaatcatggggcaaaatacaccttcctcaattcaggaagtaaaactatagatattcacattcttgataaaaatagtgattatgatacttttgacttccgtaatattatttttgaacattacaccaatgagatatttataagttttgataatcaaggaggatttgttatatcaatattaaataatgctacgagtgaagcggcgaacattaatgtattccgaaaaaacatgacttctttagatagtagtggttcattgatatatttgcctagcggtgatatttatcatatttcagatatctataaaatgtccagaggtagaaaatcgtttaaattaaatgtagaaaagaaacctgacattgatgatatcatcaatgtggctattttagaaacttcttatctacaaataaaaaaaatccccaataatgatgatagtgattatattttatgtttagacaaccctaacctctcatcttacacattgaactttaatgacttgtctggatacatatcaagtttatgggataatattaggggtagttttaccccttttcataaaaatactgtaaacatcgcccctaatgaaaaaaaatatatttccctaatcggacttgataagttgtcattcaatattgatgtttttagacaagcattagaggtaaaaaataagaatagttacaagataagtaaatttacatgggaaacgtatggtgatatcgttgtatcacctgaagatagaatttctcatctggagttagatgggtttaattatttttcacaacccgagttagatactccaatatctgactcattttcatatttatatgataattttcagatcgttgatagtgatgtgcatattaagcttcttcatctcaacagagaaacaaagcaaataacaccacatcgtattattcttaaaagatactttatagactcatttgctaaaacaagtatcactgacagagaaaagaatatatatcctgtgatttgtgattcacctgatcacttcacaagcgacatatataggcatccatttagaatagttctcgggaataagacattgtatccatcagaagaacttgtaaaattcataagcacctcaaaagaatatttaagcaatatggatgtgattaacaatgttattgttcctcaaaaaacaacaaagaaaaacaaattatccatagttagtttaaatagcaatatcaaaaatgatattgtattgtccggagtaatgaccggaacatcaaagatttttcatctaaataattcaggtgatttattgttaacaacctcaaaaactcatggtggtggggttgtggttatttttaaagattttataaataactggtggaaatataatcttactttaataacagttcctattgataataaattgtcagacaatagaataaatataaccccaatggggataaagatacaggaaacagtcagtggaaatgacaggttgtttttttaccctactccattaaaaaatggatgttttatcttgcataatccactttactctaactcattcccttctttatattcacatgaattatttgatttgattgaagcatatagaaatccaacgtattcgtatttacagaacaatattatcaatagatatatacatactgtttctgagtatgctggaaaagacggtattgccaatatgtcattatctatatacgcatactcgacatgtcgtttctggtcaaaagaaagtgtggctgtaggagatacaataaaattgtctaattatgagcatattgagtttagctttaattcatttagtaaggattactttcgtgaacaaaatagtgatatatataaaatattttttaaaattgcttcttcgagtaattcggttgttgtggataaaaatacgctcactcaaaaaaacttcctagaaaacaatacatttttcagtattacaggtatagatgagtctctctatgaaaagcatataatctttatcactcttaaggttattgtcccctcaaaaaagtagcgctgatttcctgtatgcggaatttgctgactaatcttacccagcatcagcagacgttccaaaggccacgacatacttcgcgaaacgcctgatggatgaactgcgtgcccagggttaccattttaaagtaaaaaccgtgacggaaagcctgcgccgtcacggactgagggcaaaagcttcctggaatttcagtccggtctgttaccgcgcacacagccagcctgtgtcagaaaatctgctggagcaggatttttacgccagtggcccgaaccagaagtgggcgggagacatcacgtattgtgtgcccggagttcagggcgagcatggaggctcaaatgaaccacgagtctgtctggaatattgaaccggtaactctctcctttgatattcagcgtggttgagtgatgtagcagccggtccaggatcgctgttgccagcacatgctctccgaacatttctccccagtctgcgaaccctttgtttgacgtcagtatgatgctcgctttttcatatcgacggttcagtagccggaagaactgaacgcgcagttcacgattttcacgttccagctctttcagacgctgacgttcagcggtggtgagtccaccatcaccactcccggtatcccgctcatgctgacgaacccacacacgcagagtctctggtgtacagccaatctttggggcaatggaacaaattgccgcccattgtgagtcatattcgccctgactttccagaaccatacgaactgcccgttgacggacctcgggggaaaaacgagtatttttagtcatcctgtttacctctttctcagggagtttagtctccaggatttccggggcggttcaatcaccggattgccggtatcagcagggatgacgggctgataactctgcaggatgcggaaggtaacacgcggctgatttcgccccgggaggcggtggctgaaggcgtcacactgtaccccccggacaccatcagggtggggaccggtgaccggatgcgcttcacgaagagtgaccgggggcgtggttatgtggccaacagcgtctggacggtgacagcggtttccggtgacagtgtcacgctgtcgggcggacagcagacccgggtgattcgccccgcccaggagcgggcagagcaacatattgacctggcctatgccatcaccgctcacggtgcgcagggggcaagtgaaacctttgccatcgcgcttgaaggtacggaaggcagccggaaactgatggccggctttgagtcagcctacgtggccctgtcgcgtatgaagcagcatgtgcaggtgtacaccgataaccgtcagggctggacggatgccattaacaatgccgtacagaaaggaacagcccacgatgtgtttgaaccgaaaccggaccgggaggtcatgaatgcagagcggctgttcagtacggcgcgggagctgcgggacgtggcggcagggcgtgccgttcttcgtcaggcggggcttgccgggggagacagtcctgcacggtttattgctccgggacgtaaatatccacagccgtatgtggcactgccggcgtttgaccgtaacggcaagtctgccggtatctggctgaacccgctgaccacggatgacggaaacgggctgcggggattcagtggtgaaggacgggtgaaaggcagcggggatgcgcagttcgtggccctgcagggcagccgtaacggagagagcctgctggctgataatatgcaggatggtgtccggattgcccgtgataatcctgacagcggtgtggtggtgagaatcgccggtgaaggtcgtccgtggaatcccggtgccatcaccggtggtcgcgtgtggggggatatcccggacaacagcgtccagccgggagccggaaatggcgagccggtcacggcagaggtactggcacagcggcaggctgaagaggccatccgccgtgaaacggaacgccgcgcagatgaaattgtccgtaaaatggcagagaacaaacctgacctgccggacggcagaacagagcaggctgtcagggagattgccgggcaggagcgtgaacgggctgtcacttctgaacgggaagccgcgctgccggagagtgtactgcgtgaaccacaacgggagcgggaggcggtccgtgaggttgtccgggaaaacctgctgcaggagcgactgcagcagatggagcgggatatggttcgtgacctgcagaaagagaaaaccctgggcggagactgatacaggaagacaaacactgatgacaacggataacacgaacacgacacgtaacgattcactggctgcccggaccgatacctggttgcagtcgttgctggtctggtcacccggacagcgggatatcatcaaaacggtggcactggtgctgatggtactggaccacgcaaaccgcattctgcatctggaccagacgtggatgtttctggccgggcgtggagcctttccgttgtttgctctggtgtgggggctgaatctgtcccgccatgcgcatatcaggcagtcggccattaaccggctgtggggatggggaattattgcccagttcgcgtattatctggcaggctttccgtggtatgaggggaatatcctgtttgcctttgcagtggcggcacaggtgctgacgtggtgtgaaacgcgcagtgggtggcgtacagcagcggccattctcctgatggcactgtgggggcctttgtccggcaccagttacggcattgccgggctgctgatgctggcagtcagccaccggctgtaccgggcggaagacagaacggaacgtctggtgctggttgcatgcctgctggccgtgattccggcacttaaccttgcctccagtgatgcggcggctgtagctggtcttgtgatgacggtgctgaccgttggtctggtgtcctgtgcagggaaatcattaccccgtttctggcccggagattttttcccgacgttctatggctgtcatctggctgtgctgggcattctggcgttgtgactggtatgatactgacgctgattctgcttattaataaacaacataacacaggatatttatgaaaattacggatcacaaactctctgaaggtattgccctgacatttcgtgttcctgaaggaaatataaaacatcctttgattatcttatgccatgggttttgcggtatcaggaatgttctgctcccttgctttgcgaatgccttcacagaagcaggattcgcaacgattacttttgattatcgaggattcggtgagagtgatggagaacgagggcgtctggttcctgcaatgcagaccgaagatattatttcagttatcaattgggcagaaaagcaggaatgtattgataatcagcgtattgggttatggggaacatcgctgggaggggggcatgtcttcagtgcagctgcgcaggaccaacgcgtaaaatgtattgtcagccagctggcttttgctgacggtgatgttctggttaccggagagatgaatgaatcggagagagcgtcttttctatccacgctgaataaaatggcagagaagaagaaaaacaccgggaaagagatgtttgtgggggttacacgggtactaagtgatgatgaatcgaaggtattcttcgagaaaatcaaagcccggcatcccgaaatggatataaaaatacctttccttacggtcatggaaacgttgcaatataaaccggcagagagtgcagccagcgtccagtgcccagttttggttgttattgccggccaggatagcgttaatccaccggaacagggaagagcattatatgatgctgttgcttctggtactaaggaattatacgaggaagctgatgcatgccattatgatatttatgagggcgcgttttttgaacgtgtagtagctgtgcagacacaatggtttaaacaatatctttaattgtcagtatttatacgttaaaggtcgttgaaattaacttcctgttacgatgagccgtttcaacggcctgcagggcatattttcacgaaggtcagagtaagc

SEQ ID NO: 10 - DNA, 7395 bp, Escherichia coli
gggtgagattcataagttgcacagtgctgtcttcaaagtgccacacccggaacgtaatcactgcctgctccttatggggtatcttcatggtgtccaagcatcagagttattaggtataaaactgtctgatattgatttgcaggccggtaacctgaatatccggcggctctaaacggtttgtcaactcagcccctcggctgaaacaggaggtacagtccattcgtcgctggctgaaacttcgggatgaatgggtagaagagggatatgaatggttatttaacctctatggcaggtctgctacaggtattactgttgttctggggggcactggtgtggttaatatctacgatgcaagagattctcacgatggcccggtccatcagtgcatgcggcgcgatattgtgcgagtatttttcagggggagtggtatccggatgcagaaaattccgctactcgactggttttatgcaataaatcaggatgataatcttctgattttttactgaggcggatatctctcgctgtgtttactgaaattgcggtattctgttttttctgaaaaacagaaaatctgattaaaaagagcatatgcgttaagggaaatttaagttctggttgattaactgataaaaatattaaaaaatccctgttgtcggtaatctccggaccattccgggattacacaataatatcaccatgtgtgatatctatggatcctcactgttgtttacgcgaggatattttcagaatgcttaacagacgattatttttttatgttgaatgcaaggcatcttcccgtactgatgtatcatcatgtcagtcgttgtccggggcttgtgacactctcacctgaaacattttgtgaacagatgaagtggctcgcagataataactggcggacggtaacatctgctgagcttgaatatttttatcaggggggaacgcttccacgaaagagtgtcatgctcacattcgatgatggttatcttgataactggctcagagcatggccggtcctgaaggaatataaccttcatgcacatatttttctcattacggggctgattggtaagggaaacgtacgtagcaggcaggagcaggaatattctcaccgcgactgtgaacggttgattgccgataaccgttcagatgaggtcatgcttcgctggtctgaagtccgggaaatgcgtgattccggactggttgaatttcatgtgcacacccattcacataaacgctgggacaggttgtctgtatcacgtgctgaacagtgccggctcatgaaagaagatattctggtgggaaaacaatgtctgacggaaaagctggggttctgtagttcccatctgtgctggcctgaaggatattataatcgggattatattaatctcgccggtaagcttggtttctcttatttatatacaaccgaaagaagaatgaactgtcctgaaaatggttcattacgcatagggcgtatcagcaccaaagagcgggaacattccggctggctgaaacgacgccttttttattatacaacgccacttttttcttcagtactggctcttcataaggggccaagattaccagataattaatgatgaaaattttattcactgaatcttcgtcagatattgggggccaggagctgcaggcactggcccagatgactgctcttcaaaagcagggacattccgttttacttgcctgcagagaaaaaagtaaaattgctccggaagccagaaaaagagggcatgatgtcacttttattcctttcaggaacagccttcaccttccttccatcctcagacttcgacggattatcggggaatttaaacctgatctggtcatctgccatagtggccatgacagtaatatagcaggactgagccgtctgatatgctgtcaccgcttcagtattgtcagacaaaaaacctacatcacccgtaagaccagaacgttttccctgaattatctgtgtgatttcattgttgtgcctagctcagccatgatggcgcatctgatggcggaaggtgtcaggacaccggtaacggttattccaccgggtttcgactggcccgcattgcataatgaagccatgcgaccgttacccctgcatatccacgcctgggctgcatcagcagacaatgttccgcttatcgttcaggtggggatgctacgtcccgaaaaaggacatgaatttatgctgcgtgtattgtatcagctgaagatggaagggaaatcatttcgctggctcgtggtgggcgccgggcgtgaagaatacgaagcacgtctgcgtcagcagacagaacacctgggaatgagcggagatgtgttaatggcaggtgcccttttcccagcgttaccggtctaccggattgccagtgtggtggtcatgccttcggaaaatgaagcgtttggtatggtactggctgaagcgtcagtctccggcgtgcccgttatcgccagtgagacgggcgggatccctgatgtcattcagaagaatgtgacagggacgctgttacccgtgggggatgtgtctgcatggaccggcgcactgcgcgattttttatcccgaccggaacgcttccggatgatggcagccagcgccagagaagatattgagtaccggtttgatattaacagaacggcacagatcattgtgtctctggctagtcaggctaaggggaaatgcaacagataacggcggatcctcttttcagcccgaattttgttcagcggttttccggtaacggagtaatttatcacattgtttaaatacggggacggtcaatgcatttaaataccggacagaacaggcctactttcagctggagcgcgctgggatgggcaattttttattttggctttttttccactctcctgcaggtcatcatcttcagcagtgggtacagcggaacgaatggaatacgggactcactgttattcagttgtctgtggttgatcccggtgtttctctatcctgatcggataaaaataattgcagctgttgtcggtttcattctctggggcacgtcgctggcagcactttgttattattttctctatggtcatgaattctctcaaagtgttcttttcgttatgtttgaaacgaatgccagagaggctggtgaatatttcagccagtatttcagccttaaactgttgcttatctcgctggtatatactgcggtgtccgtttttctgtggacacgtctgcgtcctgtatatattcctttgccatggcggagaattgtctctttcctgctgctttatgctctgcttctgcatccggttgttctgaaatcgttaatcagacaggagccgctgaatgatactctaggcaaactggcatcccgaatggagcctgctgccccctggcagtttgtatccagttattatcagtaccatcagcaactgaatgcactgacaaccttcctgaatgaaaatagcgcactgccaccactgggtaatctcagggatgaatcaggggagagaccacgcacactggtcctggtgattggtgagtcgacacagcgcgaacgcatgagcttatacgggtatctacgtgaaacgacgccggagctggatgcactgcgtaaaaccgatccgggtcttactgtgtttaataatgtggtggcatcgcgtccgtacaccattgaagcattgcaacaggcccttactttcgccaacgaaaagaatcctgatctgtatctgacgcagccgtcgctgatgaacatgatgaagcaggcaggctataaaacattctggattaccaaccagcagacaatcacagcccgtaacaccatgctcactgtattttcgcgccagacggacaggcagtactacatgaatcagcagcgaacacaaagtgcgcgtgaatatgacactaacgtgctgaagccgttccgggaagtgctgaatgaccctgcaccaaagaaactgatcatcgtgcatctgctgggtacgcacattaagtataaataccgttatccggaaggtcaggggcggtttgatggcattacagggcatattcccactggattaaatgcgaaagagctggaagtgtataacgattacgataatgccaatgtgtttaacgatcatgtggtggccagtctgataaaggacttcagagcaactgcgccggacggctttctgctttatttttcagaccatggtgaagaagtatatgatactccgccatataaaacgcagggacggaatgaagataaccccacacgtcccatgtacactgttccgttcctgctgtggacctcggaaaagtggcatgctgcacatccgcgagatttttcgcagtatgttgaccgcaaatacagtctggctgaactgatccacacctggtcagatttggcgggactgacatacgatggttacgatccgacccgttctctggtgaatccgcaattcagggaaaccacccgctggattggaaatccgtataaaaagaatgggctcactgatttcgacactcttccgtatggtgagccatagtattttcttatcttcggttccgttctgaaggcaggaggatgtgttttcctctgctgtccggtggcctccagggatggtaccaccttctgctgtactctgttatcataatgagataagcaggcagataccggtaaatatgaaaaatatcagaactgagtttattccccgctttaaccttacattatgcttcccccgttactggatgacgtggacaggtatcggtattatctgtgtgtttgcaatggtcccccccgcactgagagatccattgttgggaaaattgggcatgctggttgggcgtctggggaaaagcgcacgtcaacgggccttgattaatttatcgctttgttttccggagtacagtgataaagaaaaggagaatatcgttgatgccatgtttgcaacagcctccatggccgttgtgcttatggctgaattagcactgtccgggcctgataaaatttcgcatcgtatacgctggaatggtctggagattgtggagaagatggcacagaacaatgaaaaggtcatttttcttgtgccacatgcctggggagtggatattcccgcaatgctgatggctgcgtcgggcagaaaaatggcagcgatgtttcataaccagagaaatccggtggtggattatgtctggaacagtgttcgtcgtcgtttcggaggaaaactgcacgcacgtaatgacggtattgcctcctttgtccgctcagtccggcagggatactggggatattatcttcctgatcaggatcatggcccggaattcagtgagtttgcagatttttttgcgacgtataaagcaactttaccggttatcggacggctcagcaggatcagtggtgcacggataataccgcttttccctgtttatgacggaaagacccatcatctgactattcatgtcagcccgccacttgctatacgacagaagagtgatgctcatattgcgcgacagataaacgaagtggttgaaaatttcgttcgtccacatcctgagcagtatacgtggatcctcaagttgctgaaaacgcgtaaagaaggggaagaggatccttactgaggcagctttttcaggataatgagcttacccagcaatagtggacacacgctaagtgagtaaactctcagtcagaggtggctcatatgacaaaaaaacagtaccaaccagtaaaaaaccccgtaaatagcattcgcctgaatttcgcagtgaagccctgaagcttgctgaacgcatcggtgttgctgtcgcagctcgtgtgctcagtctgtatgaatcacagcttgtaagcggctcgtcagaactgtattgatatttactgagcggtcagttcaacgtaagcgagtgttatgcgccatggaagcttacccaggaatatgttatcaggcctcagcatggcgaagtgttgcaacgctggaagcagaatgaccgcggtcaacaacttgttttaccgcttcaattttaaaatcttcgggataacgcttaccgctcatgggcacctctctttaagccatttaaaatgactctgaggtgtctgttaaacccgtggcgattcaatctggatatagtggctaagaatacctttatttttttttttttttttttggtttttattttttattgagttttgttttgtatattaaatatttgttgttgattcattatcacacaaaagaatgtatcataatgcaattgtttgatgtgttaaacgttataaacatattaattgtcgtgttttgtgcttgcttatcaaaaggatagttagcttgctttttttgcaaaatataataataaaataagttaaaggacgttataagagttaattctttggtcaggatatatttacgaaacaggtgtaaatatgttataaaaataaccaacgactagtgaataagtcgctcctgaaaaaataaaatatagaaatactgttatatccggctgcatgaacactaaaatgaatgagagatggagaacaccgatgaaattaaagtatctgtcatgtacgatccttgcccctctggcgattggggtattttctgcaacagctgctgataataattcagccatttatttcaatacctcccagcctataaatgatctgcagggttcgttggccgcagaggtgaaatttgcacaaagccagattttacccgcccatcctaaagaaggggatagtcaaccacatctgaccagcctgcggaaaagtctgctgcttgtccgtccggtgaaagctgatgataaaacacctgttcaggtggaagcccgcgatgataataataaaattctcggtacgttaaccctttatcctccttcatcactaccggatacaatctaccatctggatggtgttccggaaggtggtatcgatttcacacctcataatggaacgaaaaagatcattaatacggtggctgaagtaaacaaactcagtgatgccagcgggagttctattcatagccatctaacaaataatgcactggtggagatccatactgcaaatggtcgttgggtaagagacatttatctgccgcagggacccgaccttgaaggtaagatggttcgctttgtttcgtctgcaggctatagttcaacggttttttatggtgatcgaaaagtcacactctcggtgggtaacactcttctgttcaaatatgtaaatggtcagtggttccgctccggtgaactggagaataatcgaatcacttatgctcagcatatttggagtgctgaactgcctgcgcactggatcgtgcctggtttaaacttggtgattaaacagggcaatctgagcggtcgcctaaatgatatcaagattggagcaccgggtgagctgttgttgcatacaattgatatcgggatgttgaccactcccc

SEQ ID NO: 11 - DNA, 9904 bp, Escherichia coli
gatcctcttcctgcggcggattatacaatgattgatggtaaagacattaagtcgctgaaagagcaggttatggatttgggtatccctgcatctgagctgataaagacagcctgggcttcagcttccacatttcgtgtgactgattatcgtgggggaaataatggtgcccgcatcaggttacagcccgaaattaactgggaagttaatgagcctgaaaaactgaagaaagtactggcatccctgacctcattacagcgtgaatttaacaaaaaacagtctgacggaaagaaagtgtcgttggctgatttaattgttctttcgggtaatgctgcaatcgaagatgcggccagaaaagccggggtggaacttgagattccctttactccgggaagaactgacgcctctcaggagcagacggatgttgcctcattcagtgtactggagccgacagcagatggattcagaaattattactcaaaaagcagaagtcatatatcgccggttgaaagcctcattgataaagccagtcagctggatctcaccgttcctgaaatgacggcattactgggtggtctgcgggtaatggatattaatacaaataattcttcgttgggagtgtttaccgatacccctggtgttctggataacaagttttttgttaatctgctggatatgtcaacacgatggagtaaagcagataaagaagatacatacaatggattcgatcgtaaaacgggagcattaaaatggaaagcatcctctgttgatttaatcttcagttcaaatcctgaattacgtgcggtggcagaagtatatgcctcggatgatgcgagaaataagtttattcatgattttgttaaatcgtggaataaagttatgaatagcgatcggtttgatttaaacaataaatgataaaactgatgagggagggcacctccctcatgaaggagaaattatgcagaaaagcaataaagttataatcagctgtggtatggcattatattttttgtgtggggggattacagtggcagaagaacttgatgaaagcatgcaagttcttgcaaggaatatgagtgtacttcagtcatcaatggataaaaaggagcttcttgaagctcttgacagaatggatgatgctgtagatgagtcaatgaagcgtcttcctgagagcatttcaccggctgatgaagaagggaagaatgactatataaaagaacttcaaaagcttgaaaaagagattatgctggcgaaacaaaaagtcttatcgggacagttatcagatatacccgattcggtaaacaagatgaataaaatcagagttgaggggcatgataaattcagataaatcagttggttgattcctgcgggacgaatacatacgtcaggaacataactttatggctggaacgtgaaaatcgtgaactgcgccgcagtaacgatatccttcgccaggcttccgcttattttgcgaaggcggagttcgaccgcctctggaaaaaataatgccactgctggataagctgcgtgagcagtacggggtcggaccggtatgcagtgagctgcatattgccccgtcaacgtattaccactgtcagcaacagcgacatcatcctgataaacgcagtgcccgtgctcagcgcgatgactggctgaagagagagatacagcgcgtatacgatgaaaatcatcaggtgtacggtgtgcgtaaagtctggcgccagttgttacgcgaaggtatcagggtggccagatgtacagtggcgcgcctcatggcggttatgggacttgccggtgttctccggggtaaaaagatccgtactaccgtcagccggaaagccgtttccgcaggcgaccgcgtaaaccgtcagttcgtggcagaacgtcctgaccagctgtgggtggctgattttacttacgtcagcacatggcagggcttcgtctatgtggcgttcatcattgatgtgtttgccggatgtatcgtggggtggcgagtctcatcgtctatggaaacgacattcgtgctggatgcactggagcaggcgttgtgggcccgtcggccgtccggcacagtccatcacagtgataaaggttctcagtatgtatcactggcctatacggagcgactaaaagaagcaaaactgctggcatcaacagggagtacaggtgactcgtatgacaacgcgatggcggagagcatcaatggtctttacaaagcggaggtaatacaccgtaagagctggaaaaaccgtgcagaagtggaactggccacactcacgtgggtggactggtataacaatcgacgattgctgggaaggctgggtcatatccctccggcagaagcagaaaaagcttattatgcttccatcagaaacgatgatctggcagcctgagttcacagataaaacactctccaggaaaaccggggcggttcagtgtttgttatccgtatgataacaaacacataaaggagtaaacatttatctggacgatgattacaatgttcacgactgtcagagacacacctctgatacattagaaaaaccaatgtttcccttaaaaatggagcttatatgaataaaatatactctcttaaatacagccatattacaggagggttaatcgctgtttctgaattatccggcagagtatcatcaagagcaactggtaagaaaaaacacaaacgcatacttgcattatgttttttaggcttattacaatcctcatattcttttgcgtcacagatggatatttcaaatttctacatccgtgactatatggattttgcacagaacaagggcatatttcaggctggcgcaacaaatattgaaatagtgaagaaagatggctccaccctgaaactaccggaagtaccatttcctgacttctcaccggttgcaaacaaagggtcaaccacatctattggtggtgcatacagtatcacagccacacacaatacgaaaaaccaccactcagttgcgacgcaaaactgggggaacagcacgtacaaacaaactgactggaatacttcacatcctgattttgcagtatcccgacttgacaagtttgttgttgagacccgaggtgcgactgaaggcgcagatatttcgttatcaaaacagcaggcacttgaacgttacggggttaattataaaggagaaaagaaacttatcgcattcagagccggctctggtgtggtatccgttaaaaaaaatggacgcataactccatttaatgaggtttcttataagccagaaatgttaaatggctctttcgttcacattgatgactggagtggatggctgatattaaccaacaaccagtttgatgagtttaataacattgcctctcagggtgacagcggttctgaaccgccccgggtttcctggagagtgttttatctgtgaactcaggctgccatatcatcgtttccgatggaagcataataagctttttctgcttctgccggaggagtatggcccagccttcccagcaatcgtcgattgttataccagtccacccacgttagtgtggccagttccacttctgcacggtttttccagctcttacggtgtattacctccgctttgtaaagaccattgatgctctcagccatcgcgttgtcatacgagtcgcctgtactccctgttgatgccagtaatccggcttcttttagtcgctccgtataggccagtgacacatactgagagcctttatcgctgtgatggatggtgccagacggacgacgggcccacaacgcctgctccagcgcatccagcacgaatgtcgtttccatagacgatgagacccgccaccccacgatgtatccggcaaacacatcaatgataaacgccacatagacgaagccctgccatgtgctgacgtaagtaaaatcagccacccacagctggtcaggtcgttctgccacgaactgacggtttacgcggtcgcctgcggcaacggctttccggctgatggtcgtacggacctttttaccccggagaacaccggcaagtcccataaccgccatgagacgtgccactgtacatctggccaccctgattccttcccgtaacaactgacgccagactttacgcacaccgtacacctgatgattttcatcgtatacgcgctgtatctctctcttcagccagtcgtcgtgctgcgcacgggcactgcgtttatccggatgatgtcgctgttgctgacaatggtaatacgttgacggggcaatatgcagttcgctgcataccggtccgaccccgtactgctcacgcagcttatccagcagtggcatcattttttccagaggcggtcgaactccgccttcgcaaaataagcggaagcctggcgaaggatatcgttactgcggcgcagttcacgattttcacgttccagctctttcagacgctgacgttcagcgctggtgagcccaccatcaccgcccccggtatcccgctcatgctggcgaacccagacacgcagagtctccggcgtacagccaatctttggggcaatggaacaaattgccgcccactgtgagtcatattcatcctgactttccagaaccatacgaatcgcccgctgacggacttcgggggaaaaacgagtatttttagtcatcctgtttacctctttctcagggagtttagtctccaggatttccggggcggttcagttcagcactgttcgtctatgataaccaaaagaaaaagtgggttgtcgctggaactgtctgggggatttataattacgccaatggcaaaaaccacgcagcatacagtaaatggaaccagacaaccattgacaacctgaagaacaagtattcttacaacgtggatatgtcaggggctcaggttgcaaccattgaaaatggaaaactgacaggcactggctcagacaccaccgatataaaaaataaggacttaatatttactggcggtggagatatcctcctgaaatcctcttttgataatggtgctggcggtcttgtctttaatgataaaaagacctatcgagtaaacggggatgatttcacctttaaaggtgccggtgttgatacaagaaacggcagcaccgttgagtggaatatccggtatgataataaagacaaccttcacaaaattggtgatggcacattagatgtccgaaaaacccagaacaccaacctgaaaacaggtgagggtcttgtcattcttggagctgaaaaaacattcaataatatctacataaccagtggtgatggaactgtccgactgaatgcagaaaatgcactgtctggcggtgaatacaacggtattttctttgcgaaaaatggcggaactcttgacctgaacggatataatcagtctttcaataaaattgctgcaactgattcaggtgctgtaataaccaatacgtcaaccaaaaaatccattttatccctgaataatactgctgactatatctatcacggtaacataaacgggaatctggacgtacttcagcatcatgagacgaaaaaagagaaccgtcgtcttattcttgatgggggcgtggacacaacaaatgatataagcctgcgtaatacacaactgtccatgcagggacatgccactgaacatgccatttatcgggatggagctttctcttgttcactaccagctcctatgcgctttttgtgtggcagtgattatgttgcaggaatgcaaaatacagaagctgatgctgtaaaacaaaacggaaatgcctataaaaccaacaatgctgtctctgatttatcgcagccagactgggaaaccggaacattcagatttggaacgctacatcttgaaaattccgatttttctgttggtcgtaatgcaaatgtaatcggggacattcaggccagtaaatcaaacattactattggtgacactacagcatatattgatttgcatgctggtaaaaatattaccggtgatggttttggcttccgccagaatattgtgcgtggaaactcacaaggagaaacgctgtttacaggagggatcacagcagaagacagcactatcgttattaaagataaagcaaaagcattattttcaaattatgtatacctgctgaacacaaaagcaaccatagagaacggtgctgatgtgacaactcaaagtggtatgttctccacgagcgatatcagcatctctggtaatctgtccatgacaggcaatcccgacaaagacaataaattcgagccctcaatatatctgaatgatgcttcttatctactgactgacgactccgccagactcgttgccaaaaataaagcatctgtggtgggagatatacactccactaaaagtgcatccatcatgtttggtcatgatgaaagcgacctctcgcagttgtctgacagaacctcaaaagggcttgcacttggtcttttaggtggctttgatgtctcatatcgcggttcagtcaatgccccgtcagcatctgccactatgaacaacacctggtggcaactaaccggagattctgcgctgaaaacactgaaaagtacaaacagcatggtctatttcactgacagcgcaaacaataagaaattccatacgctgacggtcgatgagctggcaaccagcaacagcgcctatgcgatgcgtacaaacctttctgaatcagacaaactggaggtcaaaaaacacttgtctggtgagaacaatattttactcgttgatttccttcagaaaccaacgcctgaaaaacaactgaatattgaactggtaagcgcgccaaaagacaccaatgaaaatgtctttaaagccagtaaacaaaccattggtttcagtgatgtaacgccggtcattacaaccagggaaaccgatgacaaaataacatggtcactgacaggctataacacggtagcaaacaaggaagcaacccggaatgccgccgccctgttctctgttgactataaagcgtttctgaacgaggtcaacaacctgaacaaacgtatgggtgacctgcgtgatatcaacggcgaagccggtgcatgggcacgcatcatgagcggtaccggctctgccagtggtggtttcagtgacaactacacgcacgttcaggtcggggtcgacaaaaaacacgagctggacggactggatttgtttaccggtttcactgtcacacacactgacagcagtgcctccgccgatgttttcagtggtaaaacgaagtctgtgggggctggcctgtatgcttccgccatgtttgattccggtgcctatatcgacctgattggcaagtatgttcaccatgataatgagtacactgcaacctttgccggactcggaacccgtgattacagcacgcattcatggtatgccggtgcagaagcgggctaccgctatcatgtcactgaggatgcctggattgagccacaggctgagctggtttacggttctgtatccggtaaacagtttgcatggaaggaccagggaatgcatctgtccatgaaggacaaggactacaatccgctgattggccgaacgggtgtggatgtgggtaaatccttctctggtaaggactggaaagtgacagcccgtgccggtctgggctaccagttcgacctgctggctaacggcgaaaccgtattgcgggatgcatctggtgaaaaacgcatcaaaggtgaaaaggacagccgtatgctgatgtccgttggcctgaatgcagaaatcagggataacgtccgctttggactggagtttgagaaatccgcctttggtaagtacaacgttgataatgctgtcaacgctaatttccgttactcgttctgatactccgtattcaaaagggcctgcgggccctttacgctcagtgcctgccgccctgatatgtctgagagacatttccgggatgtcagtcgactggtttacttaactgcgatgactaaagctggcagtaatgccggcttttttacggccacatacgtcttcctctcatccggaactgtgatacaaatcctgcatacaggattgaccgccggttcctgcaaatggcacattttcagtaagatagcgaaggttacatttgtcactggttaacataccgatggtaaaaggggcaagcagcgccagcaattcatcagcccgggggccaaaagtgtaggccagaacgccaccagttttcgtgttgtacgcgtaccagagcctgtgctgtcacgctttactgccgataaaactccattgctcatcaagttcgcagatgagtgccatatcagcatgagcgaccggggatgacgttattcttcgtggcgagcgttttttaaagtccgaatgacagtattaatgccgattttcagcgtacgggcagtatcgcgaactccggcaccgttgaaaggcatttcagtgatttggtcttgaactcccggtttacgggcctcgtaacggtaagtgagctgaaacactcgatgacagtcacggcagcgaaatcgatcatgtccttttgggttcttcccgtgacggtaaacctgaacggactggcaacgggggcaatgaaggttaactgtgaccattaaagaaccttaaaagtgactattatacccctaattcaactaattggaggcattaccatgcattagtgcaagcgccttgtggattcttttgctaatggcggaaacatattgtacaatattgcatttatccctcaataaataaatgagttatcagattgcaaaaatctgttatcaaactaattcaaataaaaagagattgatacgaccaacgtacacaaaaattttcgatattcgaactaaataacagctcctaataccgctacactttagctatccagtctgcgcctcagaaatggacgatgccgttgaaggactggtgtatggcaatgagccgctttattatcgaattcggtgaccgcttggacggtcacttcggagaaaaggcatttacacagcatcctaaacaggttcagcataggtgatataccgccttttcattttcttctccattatttataagggaggtgtattattatgcaatattattggttttatccattgtttttagttcatgaatgtttgcaaaaaaaataaatgaacaataattttatgtatttaaaataaattgattttacttctgtaatggtgtcatgattagcagctttttaaactaatatcgactttcaataaataaggacaggtaatggacaacaaaaatatctgaacccgggtgagattcataagttgcacagtgctgtcttcaaagtgccacacccggaacgtaatcactgcctgctccttatggggtatcttcatggtgtccaagcatcagagttattaggtataaaactgtctgatattgatttgcaggccggtaacctgaatatccggcggctctaaacggtttgtcaactcagcccctcggctgaaacaggaggtacagtccattcgtcgctggctgaaacttcgggatgaatgggtagaagagggatatgaatggttatttaacctctatggcaggtctgctacaggtattactgttgttctggggggcactggtgtggttaatatctacgatgcaagagattctcacgatggcccggtccatcagtgcatgcggcgcgatattgtgcgagtatttttcagggggagtggtatccggatgcagaaaattccgctactcgactggttttatgcaataaatcaggatgataatcttctgattttttactgaggcggatatctctcgctgtgtttactgaaattgcggtattctgttttttctgaaaaacagaaaatctgattaaaaagagcatatgcgttaagggaaatttaagttctggttgattaactgataaaaatattaaaaaatccctgttgtcggtaatctccggaccattccgggattacacaataatatcaccatgtgtgatatctatg

SEQ ID NO: 12 - DNA, 3812 bp, Salmonella thyphimurium
gatcgttctttacggctggtccagaaaccatgtaccagtaaagcgattatggcgatcgcgccaacaatgattaatatcagacgcaaatcctgcatcattatattctctgttgttctaacaccttgccaccacggcaaacatttactcactaagagtatttgccgattacgtcaagtgcaagtgtactgttggctttcgcagcataaagatgaaggaaaatgtgctttttgctgttttttcgaacatttccgaactatccaccgtctgataaccgggtaagatatcccacgtttacccagggctttaagaaaaaggagtatgtcctgaatatggtttcatcatccacaaccgtaccacgtagcggcgtctattatttctcgcaaggatggaagttagtcaccctaccgggaatccgccgctttgttattttacctttgctggtcaacattgtgctgatgggcggcgcattttggtggctgtttacccagcttgacgcctggataccttcgttgatgagtcatgtgccggactggctgcaatggctgagctatctgctgtggccgattgcggttatctctgttctgctggtctttggctattttttctctaccctcgccaactggatcgccgcgccgtttaacggccttttagccgaacagcttgaggcgcggttaaccggcgccacgccgccagatacaggcatactcggcatcatgaaagatgtaccgcgcattatgaaacgtgaatggcaaaagctggcgtggtatctgccgcgcgctattgtgctgctgattctctattttattcctggcattggccaaaccatcgcgccggtgctgtggtttttgttcagcgcctggatgctggcgattcagtattgcgactatccgtttgataaccacaaagtgccgtttaaaacgatgcgcgccgcgttgcgcacgcagaaggtggcgaatatgcaatttggcgcgctcaccagcctctttacgatgattccggtgcttaacctgttcattatgcctgtcgccgtctgtggcgcgacggcaatgtgggttgattgctggcgtgctaagcacgcgttatggaaataacgtaaaaatgtataaataagagatggcttatgctgtctcttattccatactgataaccattatttcccatcagcatatagatatgcgaaatccttacttccccatatctggctggaaggtatgctgggaaggtatcccaatttcatacagttaaggacaggccatgagtaagatttatgaagataactcgctgactatcggtcatacgccgctggttcgactgaaccgtatcggtaatggacgcattctggcaaaggtggagtcgcgcaacccgagcttcagcgtcaagtgccgtatcggcgccaacatgatttgggatgccgaaaagcgtggcgtactgaaacctggcgtggaactggtggagccgaccaacggcaacaccggtattgcgctggcgtatgtcgccgccgcgcgcggttacaaactcaccctgaccatgccggaaaccatgagcattgaacgccgcaagctactcaaagcattaggcgcgaatctggtgctgaccgaaggggcgaaagggatgaaaggcgctattcagaaagccgaagaaattgtcgccagcgatccgcaaaaatatctcctgctccagcagttcagcaaccctgccaacccggaaatccatgaaaaaaccaccggcccggaaatctgggaagacaccgatggtcaggtggatgtgtttatctccggcgtcggcactggcggtacgttaaccggcgtcacgcgttatatcaaagggacgaagggtaaaaccgatcttatcaccgttgcggtagaacccactgactccccggttattgcccaggcgctggctggtgaagagatcaaaccaggcccgcataaaattcagggtatcggcgcaggcttcatcccgggcaacctggatctgaaactgattgataaagtggttggcatcaccaatgaagaagctatttctaccgcgcgccgtctgatggaagaggaagtattcctggcaggaatttcttccggcgccgcggttgctgcagcgcttaagctgcaggaagatgaaagctttaccaataagaatattgtggttatcctaccttcatcaggtgagcgttatctgagcaccgcgttgttcgccgatctctttactgagaaagaactgcaacagtgatgccagcatgttaaaaacgcgtaaaaaagcacctttttgggtgcttttttgtggcctgcttcaaactttcacctcacctggcattgattcaccctgccggaactggtatttaaccagactaattattttgatgcgcgaaattaatcgttacaggaaaagcgttagctgaatcgattttatgatttggttcaaatcttcctttcgcggcataatgtttaatgacgagcgaaacgtcagcggccataagttgccagcaacggattgcgtagaacaccttttgtgtcgcgtcccgtttacgccggcgctaacaatacaggctaaagttgagccgccaggctagactttagttccacaacactaaacctataagttggggaaatacaatgttccagcaagaagttaccattaccgctccgaacggtctgcacacccgccctgctgctcagtttgttaaagaagcaaaaggcttcacttctgagattactgtgacttccaacggcaaaagcgccagcgcgaaaagcctgtttaaactgcagactctgggcctgactcaaggcaccgtcgtcaccatctccgcagaaggtgaagatgagcagaaagcggttgaacatctggtcaaactgatggcggaactcgagtaagtttttttccgggttcttttaaaaatcagtcacaagtaaggtagggttatgatttcaggcattttagcatccccgggtatcgctttcggcaaagcactgctgctgaaagaagacgaaatcgtcattgaccggaaaaaaatttctgccgacaaggttgatcaggaagttgaacgttttctgagcggtcgtgccaaggcatctgcgcaactggaagcgatcaagacaaaagctggtgaaacgttcggtgaagaaaaagaagccatctttgaagggcatattatgctgctcgaagatgaggagctggagcaggaaatcatagccctgattaaagataagcacatgacggctgacgcagccgcacatgaagttatcgaaggtcaggccactgccctggaagaactggatgacgaatacctgaaagagcgtgcggctgacgtacgtgatattggtaagcgcctgctgcgcaacatcctgggtctggccattatcgatctgagcgcgattcaggaagaagttatcctggttgccgctgacctgacgccgtcagaaaccgcgcagctgaacctgcagaaagtgctgggcttcatcaccgacgcgggcggacgcacgtctcatacctccatcatggcgcgttctctggaactgccggcgatcgtaggtaccggtagcgtcaccgctcaggtgaaaaacggcgattatctgattctggatgccgtaaacaaccaggtttacgtcaacccgaccaacgatgttattgagcaactgcgcgccgtccaggagcaggttgcgaccgagaaagcggaactggctaaactgaaagatctgccggcaatcacgctggatggacatcaggttgaagtttgcgccaacatcggtaccgttcgtgacgttgaaggcgctgagcgcaacggcgcggaaggcgttggtctgtatcgtactgaattc

SEQ ID NO: 13 - DNA, 874 bp, Salmonella thyphimurium
gatccgttaatgacgaaaataggcaacttatactccgcgagcaagatgatttttatttttgacgccactaagaataaaaattgcgagacagtttccgaaaatagagttgatctttcatcgccacaggggtactgtatgaatatacagtaactcacagggctggattgattatgtacacttcaggttatgcaaatcgttcttcgtcatttcctaccactacccacaacgctgcgcgcaccgctacggaaaatgccgcggcaggactggtcagtgaagttgtctaccacgaagaccagcccatgatggcgcaactcctgcttttgcctttactccgtcagttaggccaacaatcacgatggcagctctggctcacgccgcagcaaaagctcagccgtgaatgggtacagtcttcaggtttgccattaacgaaagtgatgcaaattagccagcttgcgcctcgtcatacgctggagacgatgatccgcgctttggctacaggaaattacagcgtggtaattggttggatgactgaagaactgacagaagaagaacatgccagcctggttgaagcagcgaaggtaggtaatgcggtagggtttatcatgcgccctgtacgtgcgctcgctttacccaggagacagcattccgggctaaaaattcactctaatttgtatcattaagtaaaattaggatttatcctgggacttttttttacgcgaacgtatctcctttgagtgctaacgttttttttgcgagaacgcttgtcagaagcggtttccgcaattattgctgtacgatttatcatctgaaactgttaatgatgtgtatatccgtcatgtttttttcacatgtctgacggagttcacacttgtaa

SEQ ID NO: 14 - DNA, 13311 bp, Salmonella thyphimurium
ctgcagcgccgactgcactccgaacagcttcagtttgagcaggcgcaaacccagcaagccgcggtacaggtgccaggaatccaaactttaggaacgcaatcgcagtaatgaagcaactttggtttgccatgtcccttgtggcggctagcctgttcttctcagcaaacgcctcggccgaccctgcgtccggggcgttattgcagcagatgaacatcgccagtcagtcactgaattacgagctgtcattcgtcagcatcacgaaacaaggcgttgaatctctgcgttatcgacacgcacgcctggatggtcgcccgcttgcgcaattgctacagttggacggtccccgccgggaggtcgtacagcgtggtaatgaaatcagttattttgaaccgggccttgagccgttcaccctgaacggtgattatattgtcgattctctgccttccctgatttacaccgactttaagcgcctggcgccttactacgactttatttctgtcggacgcacccgtatcgcagacagattgtgcgaagttatccgcgttgtggcgcgcgatggtacgcgttacagctatatcgtctggatggacatggacaccaaactgccgatgcgcgttgatctgctggatcgcgatggcgagacgctggagcagttccgcgttattgcgttcacggtgagccaggatatcggcagcaacatgcaggcgctggcgaaggcgaatctgccgccgctgctttctgttcccggtggcgaaaaaacgaaatttaactggagtccatcctgggtgccgcaaggctttagcgaagtttccagcagccgtcgtccgttgccgacgatggataacctgcctatcgaatcgcggctttattctgacggtctgtttagcttttccgtcaatgtgaaccgggcgacgcaaaacagcagcgatcagatgctgcgcaccgggcgccgaacggtttatagcagcgttcgcgacaacgcggaaatcaccattgtcggcgagcttccgccgcaaacggcgaagcgcattgccgacagtatcaaattcagggcagtacaatgattaaagagtgggcaaccgttgtctcctggcagaatggtcaggcggtggtgagctgcgacgttaaagcgtcatgcagcagctgcgcctcccgtgcgggatgcggcagtcgcgtgctgaataaattagggccgcaaaccacgcataccattgttgtgccaagcgcggagccgctggcgccggggcagaaagtcgagttgggcatcgccgaaaaaagccttttaggttcggcgttgctggtctatatgtcgcctttagcggggctatttctttgtgcggcgctttttcagatgctgtttggatctgaccttgccgcattaagcggggccgtgctgggcggcgtgggcggttttctggttgcccgcggttattcccgaaaactggcggagcgcgacgcctggcagccggtgattttaaacgttgccctcccgcctgaccttgttcgcgtcgaaactacctcaatcgaaacgcgccagtaaacgttttgcccaacggtacacctgccgcgttgggttgttgtcccgataagcatgcgcttttcctgcgttgcggtgttttacaggaaaaaagcgaggcgttttccagttcccgctctccttacactatgaacatttcctcgccttagcgttgtagtgtagaatgcggcgtttcagttaaaacagacgttaagctcagaacagcgacctctaaagtctggtcaaccaggcgtaaggcataataatttatctctatgaagaacatacgtaacttttcgatcattgctcacatcgataattgataccccgccaccctccgcaaacctacgacaaaatcctctcaagatccccgcaaaataagcgctcacaaaaatgatactggttgcatgtacagtcaacctacgacatcatgagtcatggtttttgtgtccaccagtgcgtccatatcctatgatggacacagaatcttccgttctgatggacacatgcagggataaatcatggctatttcagatagttatctaaagtcgtgcctcgggcgcgaacgcgataaagttgaggagaaggcagaccgggacggtctgtgggtgcgcatttccaaaaagggcgccgtcacttttttctaccgattccgtttcctgggtaagcaggacaagatgacgatcggcagttacccggaattcgggttgaaggccgcgcgcgaagaggtaactaagtgggccgccattcttgcccggggagaaaatccgcggatcaggcaaagcctcgataaagctaaaatcaacagccagtacacattcgaggaacttttcagagaatggcatgcgatggtatgcgttcagaaagaaacatccgatcaaatactgcgttcgtttgagctgcatgtattccctaagctgggtaagtatccggcgcatcagttgacgctgcacaactggcttacagttctggaccgactggcgcagggatacactgagatcacccggcgagtaattagtaacggtcggcagtgctactcatgggcagtgaagcgccagttgcttgaggttaacccactttctgaaatgtccggtcgtgattttggtattcagaagaaaatgggggagagaacactggatcgcaaagaaattgcgattgtctggcgagctattgaggattcccgccttattgagcgaaacaagatcctttataaattgtccctgatatgggcgtgcagggtcggtgaactccgtcaggctgaagtttcgcatttcgattttgaggagggcgtctggaccgtaccgtgggaaaatcataaaacgggacggaaaagtaagaagccgataatccgcccgatcatccctgaaatgctcccgctgatacaacgagccattgagctggcgccaggccgttttgttttctcaaaatatgcagacaagccgatgagcgaaggctttcatatgagcatcagcagcaaccttgttaagttcatgctgaaggcttataacgagcaggttccgcactttacgatccatgatctacgcagaactgcgcgaacgaatttctccgagctgactgaaccacatattgctgagatgatgctcgggcacaaactgcctggagtgtggtcggtgtacgacaaatacacctatatcgaagaaatgagagaagcttatagtaaatggtgggcccgactgatgagcatcatcgagcccgatgttctggagttcacgccacgtcagaccggatgagtcgacctttgttgtcacggggcagattcagatgcgacattggacggcgtgttggtcgtgacatttccctgacctgccactcattgactttggttttaagccatttgttggagccacccatatatgaacagtcaggctccgggaatgggttgttgtcgcttggtcgcttacggtaacgctccagcgtcctggaagaaatcctgagctggcagcaaatttcgcgggtgctcatcaattcaaagtctctaatttttttgctcatcgttttctccagtggccccgcagcgggccatcgctaatattcagtttgcctgtgctggcagatttctaagtttccggacgccgatcattgcggtggctacgtagctggtggcccggttaactacttcaacaggcacctttacgccatccactacaacggtgtaattggtaacgtgcttttgtctgccgtaatcgccgaacttttcatgatgcgccgccagtgcaacatcacatgcgcgacggcccaatggcgattgcttactgcgatttattaggcgcataaaacctcctcaggtgggagggcgtaccccctcccgatgcaattagccgatgtattccggtttcatatcgtccagggtgacgcggtacttatcgtgcagttcgtcgccaagatgacgtttagcagcgccaagcgtgctttcagctttagcaaacatctctgcggcttccggttcgccagggtttggaattgagttgatcactgcctcgactttgttctgtgcattgacctggtaatagcgcttcactgctttgttttttaattcggtgaacagcgcagtacccagcaacgctttctgtgattcgatatccgcacggattgcttttgcctgatcaacggaacttgctgtatcaatgcgttcgcgaagatcgtcggcaacagcatcaacgttagctgccgactcctgcgcgctggtcctggtgctaacctcgctggtgatttcctgtacgctcatgcgctggactggagcagggttaatctcgcgttcttctcgttgctcaacctcatcagggctgtacacgccgaggatcacttccgggcagtacaggcgagcccaatatttaacgcccagataggcaatttgctgtttagggtttgaaacccatagcggagaattgcgggtaacaacgccggagaggtaaagaggttctccccaggtgatttcagattcacctcgcagaatggcaccaacctgaacgaacaggccgatctcgtcctcatccgtccagccacgaacgcgctcagtgacggtgtacttcccatttttaccgtttttatcgcgtgtgatttcctgtgtcctggtgcagcgctcccagtcacccccatagcggtaatgaaaacggccatgaatggcactggagcttgcgattactgcgttgaccagttgtgcctcgtaaccaagaacaccgttaaccaggtgtgttttctgagccacagcgtaagggttcatgccccattgcatagcctgcatgacgatagccatacagtcggctggtttccctgcaaggtgtgccggtaccgtcacctgtgagtctgccatcaggttagcgaaagctgttaactgacccagtgcctgaacgttaaaaattgcgttactggcagaaatggtgtttggtgcctgctgctcagtggtaacaatatttgtgttttccatgattttccccttatgcctgtacgcgcaacgcttcaaggcggcgcacatcaaaatcgttcagttcgtcggtgtagtcttctgtgataggcgctgaccattcaccagtgtcgaagccgtttgctatctctcgcattgttttgcggtattccagcatgccaagttccagcaactcggtagacgcctcaatgatggcgacccagtggtagttctcgtctttgttgacgaaaatccagaaaaactggtccagcgccgcagtttcgcagtacatggccgcgctcaggtgatagtcccgatcgatgatttcccggtgcaacttcgcacgcaggccttcctgcttgatgttccacatgctgatagttttcaggtcggcgccaatgcgcaggccgcccatatcgagctcaaggtcagggcgtacccgaacttccaacccggtttcctcatcaatcccaaaatagctaacctcgacagcgcggcttgggtgagtcagcaatttgccggcggtcgggtgctccagcagggctttctgaatgttcagcgcggtgctgagctgttggcgggtgaccagcactttcccttcggtgttctcccgccacgcatccagcaattcgtcggcgaataccactgccgggttgactgatttcacggcctgaatcagatcggccttcgtgccagagactttcaacggcgacgatttttgcgcttcctgagcgaccaggtcagggttgattattgccagttgctccagcagcgcgtcacggctgccgctggttttaaccggcgcgggcagggtggcgttgtactctttgatgcaggctttcatcgccgtggctgtatgtttggtgccgttttcaatgcgctggaattcttcgggaagctgctcatacgatgcataggtttcatctaccgaagctccaagcggcatctgcgacggcagggtggcgttgtactcttccagcagcgctttgatatcgtcagcactcagcagcgctggcaggctggcgttgtgcgcgtcgatgaactcgcgcagggtggcggtggtggtgaaagcaccctcagggatctccggctctacgctgaactccgcttcgaggttttccggctgtagagccagaacatgtaccaggttgcccatatcaagcactggagagcgctctttgacgatagtcttctctacgtgacgcgcgttaaagtacatcagcgacacgcgagcatctttcacctgagttgagctgatcccgttggcggcgtggtaaacctcgtttggtacaccttcatagcggcccggctcgaagtattccggccaggctgcttctggctcttcttgttgcgattccggtacgttttgttgcgcctcaggttcagattggctcacagaatcgttgttctggtgcgtctcagcctgattctggttctctacggtaactgcttctttaccagtacccagatcgccttcgcctgcctgcaccgcatcaccagcctgtttttcatcactgtcagctttttgaacctgcacattgctggtggtctccggattcgtttctgtgccatgagttgatgagttctgcattaaagcggacacgtcgaaaataccgttgccaacatttttaaccagttcaggttcggtggtcggctggcttgtcccggtcttcacccattttgggtcgttcgggtcgctgatgccttccacatattcaccgcgcgcggcggcaagctgtcggttggcttcttctaccgcgtctttttccggagtgtgtcgggcagccgtgagagcttcctcggtggggttctcgtgatcagtctccgttaagttggcgttgatatacccctgaaggcgtccggggtagtgataaaactcagggtgcgcgcttcggatcagcgcgaaaatagcggcgcgggaataatccaggataccgggcgttgcgcgaagtgctgcggaccattctttgaacggactttcctttttctttacgatttcttttgcgcgacggtaaacgctgccaggtagctcatagatattaaagtccataggcaaagtggccattgcaatctctacgtccagagtatcgagagtatgttcgtaatcagggttacggtcagtcttattgccaccgccagcgttggcgccgctttcagtgcgttgaatagccgatacacggttgcctttcgcccactccttaacgagcaaaccgcgatcgatatgctccgtctcgaaccatgttttaaggaactggataacagtcgccagttcaggagtttttccatcgacagggaatatttttttaacggcattcactattttgtgaatgtcatgttcaatggctttcttgaacgcttcaacattctcggcggcaagcagcaggttctggacatatgaattatcggtgtccatttcgagacgcagaatttcttttttctgggaggcgtcgacgtgataaagatactcaccttcacctatgtactgagcaagaacgcggtgacggagaggcatagttgcgacaacagtcagctcgggggctggggctgttgcctgggcagggctgttgctttcgttaccaaaattttcggtgtggtcttccagcacttcgcctgtttcggtatcaacaccatcgacgatatgctggcgcgccgcggcggcggcttcagatgatggcagggtgacgccggggatttgcgtccaggtcatattgtctttagcgagttgatagtaatcgcagaaagtgaggctcagttcgccttccggcggcagctcgttaacgacagggaaattagtagcgacagctttgaaataatctttcagcttcgcaccggatttaatcagaagataatccagtgttgcatttgccgcttcaaaatcatcactgcaccagagtacagcgtctttctggcctgatgatttctttgctttgcggactaaaaatacaggattagttccactcattgttttgtcctcaattcgtgtagaatggaggtgccttaacagcaccccgatatatctggttgttaggtccggttcgctttggtcggttggaccggacagggcacgcccgcttcggtgggcgttttcttaatggatggtctgataaaatttttctgagtaatcaagcttgtaacttcggtaattaccaaaccctgcttgttctccatcacttaccttgactgtgagcagcgaaatggcttttacagcacaatgaggacagtcgaactttccgagtacatatccaccgtcgagaatcacagtggtttcgccagttgaatttgagtgaataacgcctgagactttcttttcgcaattgaataaagcaatgctcttattaactgctttcaggttcatttcgatttttacgatttccataatttctccagtcttaaattcagggtgtaggaagccacgccaaattaatggcgaatttttcatttcatatttcggaactactatttaactttcgtgcgccatctggtcgtattcagcgcactgcctggaacaatattccttttctttgcgcgccagttgcgagccgttgagatagagaagggtgttttttacttctttgccttcatcaatggatttgcggcagtaaccgcattgtttaagcatccggatctcctttctgcgccagcaggtagcagaggcggcggattaaaacctcaatccggttgagcgggacggcctgctgtcgagctggtttacgtgcgaaatcaatcattctcaccctcgtttgccttatcgccggccagcggaacgttttacacctgacaacgatgcgcttgttgtcgatgaaactaacgataaaaccaaaggttcgatttgtaaagcaaaaagtgcaactaaaagttctatcttggagcataaaaatagcacctaaagaggtgctacctgtatggatgagttctttggttctattttttgaggtcgttaattagatcaaaaacgttgttcttcagcagatccatctcttggaggactgcttttgtatggaggataacacgcagtttctctgcttccgggagttgattgaaaagagaaagcaatgtttcttctttttcatcaaggactctgggtttaggttcagccctttcgccttcactttcatcccctggctccatgaagaaccaatattcaggccttccggtcaccgccgataaccttttcaagcgctctccgctggctacagacgtgccagaggcccactttctcacagatgtgtgagaaagcattacgcgccgtgagaggtcagccatagaccagccgttctcatccagaacttgctggatacgcttggcgaaaatgggatgaagatttttgttcatattcacattttacaaccttcagtttctttattcattggaactattagattgatttttgttggaacctaaagttttacgtgataatctccagctaccaactcgtagaactggagagccaaatggacaaccaattaaaaatcaaaatcagtaaccacatgactcaaatgagcatcggcgaacattttggtatctcgtctcaagctgtaggcaagtggctgagaaaaggagtaattcctccccgtcgcatcctgccgttatgtgaaattcttgaatggaaagtcactcctcacgagattgacccagcagcatacccaaacccaaccgatggcttaccaagccaagaggcatcagccaaataaccatagaggatatttacccatggagaacgcaattgcacgaaagttagacccaccagaaatcaacccgattgagatagagagcgtcctgctcaaccggcttgcatcagtagggcagaaatcatacgccgagcatatgggcatcagcgagtcgacagtcagcaggcgtaaagctgagggatatttctgcaacatggcgaaagagctggcttttcttgggattcaggccgcgccaccggaagcggtactggtatccagaaactatctcacagcagtagagattctcgctgatgccgggctaaaggctgaacgagccaggccggatgcgctggggtgggactgaaaatggcagcaactaaaaaggcgaaagccgcggtgaggggtcaccaacggctttctggtgcaaaaacggtaggtaattgcggagatgagtatgtcaaataccgctgaaatatacaaattccctgcgccgataccgacgcaacaggagtgccgtatggctgatctggaaaatggctatttacgtttagctaatcagatccaggacgccttgtgtatcgttgaactatcggggcgtgagttccgtgttttgaatgcgattatccggctgacttatggctggtcgaaaaaatcagatcgtattgccaacagcctcattgcagataagacaacactgaaggtaaagcatgtatccgaagcggtgctgagtcttgcctatcgtaacatcattatcctgcgccgtattggtcaaacaagatacatagggattaatacaaacctggataaatgggcttattccaagccacattgctcaaaatgtccggtgtcttttcctgatgatgaaattgccacatggattatttctgtacctgaaaccagggatagttatccccgaaaagggggaagggcatccccgaaaacggggatagttatccctgaaaacagggatagcgttttaccccattcagccatccctgaaaacggggatagttatccccgaaaagagggaagggcatccccgaaaacagggaacaccaaagacattattccaaagacaaatataaaagatctaaccccctttaatccccctaagggaaaagtgaagtttgatccgttgagtattcctgttcccgaatggctgaatgctgcgtcgtggaacgaatgggtcacataccgccagcaatccggaaagcccataaaaaccgaactgacggtaacaaaagctttcaggcttctgaaggagtgcctggatgaaggccacgatccggtaaacgtcatcaacacaagcattgccaacggctaccagggactattcaaaccgaagttcgctctcaacgaccgaagagctggcagagatgtgaaccacatttctgcgccagacaaaaccattcctaccggattcagggggtaacgatgaaaaacgtaatcggtactggcagtgcgcttgatcgcctgaaaagaattatcccagccagtgtgcagccgaaattctcgactgctgatgagtggcgggcatggcaggaagccgaagggcgtaaacgcagtgaagagcttgacaggatgaatcagaaatcccgcaccgagaagattttcgggcgatctggcattcaggatctccatcgtagctgtacgtttgctaactacgaagtaagcggggaggggcagcgaaaagcgtacacgatggcaaaaagttatgcccagaacttcggtagtggatttgcgagctttgtgttcagcggtggtccgggaaccgggaaaaaccatcttgcggcggcaatcggaaatcatctgctggccggcggtcatagcgttctggtggtaactattcctgacctgatgctcagggttcgtgagtgctacgacggtgggcaatcagaagcgtccctgcttgatgacctttgtaaagttgacctgctggtactggatgaagtcggtattcagcgcggaagcagtggtgagaaggtcattctcaatcaggttatcgatcgccgtctctcatcgatgcgacctgttggcgttctgacgaatcttaaccacgaggggctgttggattcactgggcgcgagggttatcgatcgcctccagatggacggagggatgtgggtgaattttgactgggaaagctaccggaaaaacgttagccacctccggattgtgaaataaggggttaaaaatggcccgacctaaaacacaaagcgaacggatgattattcttgagcggattatcggtctggtgaaagagcaggggcgcatcacgacgaacgacgtcgttgcgatttttggcgtgcaccgaaccacggcggagaaatatctgcgtatcgcgctggagcgaggcggcttcattcgtcatggccgctgcggcattttccgagaccagcgtgcggtgattgattatgacctcaggcgatacagcagtagtcaggtaacgggattttcagcgctgccggtgctggagaaaagcccggtaatgcaggtttatggagcatccaaaatgagcatcaacaaggggggagcccaatgagcaacatcgacaaacgggcgcttcgtgaagtggctgagagggctacgccggggaattggcgccgcacctcatcactgttcaatggcatcacggtaacgccattttctctttgcggtgaagaagtgacgttggcccatactgttgagaaacgtgacgcggaatttattgccgccgctaaccccgccaccgtgctggcgctgcttgacgtgctctatgagtttggagaggatgaggtggccatctctgaatacgtcacaaatcttgaagatgctttgcgagttgcggcagcacctcagcaggaggaatgatagctggttaaatccacagcagaaagcaaaagcattattaggtacaatcacactaactttttgttgttaattatttgatgaattacgaggataagctcatgtatcagcgaatgatttttgaagaaggaaaagagccaaggttgtattcaagccaacatgactccaagtttatcccaataagtaataacaatggaaaagttcaaaaggttcctgttatggagctcaaggataccagaggagatgttttttatgcttacaactatgcttattctggtaaaaaaccatcaaatgacgaaatctataaggctattgatgagctaaagccaatcggtgaaaaattcgaaatgtctaagactataagcgattagataaatctgttttcaacattgcagcaaaatcacaggaagatcgagacaaagttagcatggcgatatatggaaatgtcggagcagaacaccaagaagtaagcgtaatttgaatgaatgtgaacccgccgagtacgggttttcttttatctgaacccgctgcggcgggttttttgcctaaaatgtgatatgaaacaacacactagcctttgcaaaaagtgctattcaccccttgaatattctttctaacaggtatactgtgtttatatacagtggttgaatgtagagggaattatgagaattgaacttgttatcagccgggcaaaacagcttccggaaggtgccgttcctgcgcttgaaaaagaattaattacccgtctccagaatcagtatgaaaactgcaacttaaccatccgtcgaggcagtcaggatggtctgagtatcgtcggtgctgctgatggcgataaaaaacgtatacagagcattctgcag

SEQ ID NO: 15 - DNA, 10387 bp, Pseudomonas aeruginosa
gcaagggagggaagggcgcatgaacctttgcctcgatagcctgctgaacggcacccaggatcccaaggcgttcggccgtgtcgccgtgctgttcggcggcaagagcgccgagcgcgaggtgtcgctgaagtccggcgcgatggtcctgcaatccctgctggccgccggggtcgatgccttcggcatcgatgtcggcgaagacctgctgcaacgcctggtcgaggagaagatcgaccgtgccttcatcattctccacggtcgtggcggcgaggatggcagcatgcagggcctgctcgagtgcgcgggcattccctacaccggcagcggcgtgctggcctcggcgctggcgatggacaagctgcggaccaagcgggtctggctcagcctcggcctgccgaccccggactacgcggtgctggccagcgaggatgactgccgcgaagcggcgcagcgactgggtttcccgctgatcgtcaagccggctcacgaaggctcgagcatcggcatggccaaggtcggcgggctcgacgaattgatcgcggcgtggcgcgaagcggcccgctacgactcgcaggtgctggtcgagcagtggatcagcggcccggaattcaccgtggcgaccttgcgcgggcaggtgctgccggcgatccgcctgggcacgccgcacaccttctacgactacgacgccaagtacctggccagcgatacccgctaccaggtgccctgcggtctcgacgaggccaaggaacgcgagctgaaggaactcaccgcgcgcgcctgcgacgccctgggcatccagggctgggggcgggcggacgtgatgcaggacgccgaagggcgtttctggctgcttgaagtcaacaccgcaccgggcatgaccgaccacagcctggtgcctatggccgcgcgggccgccggcctggatttccagcaactggtgctggcgatcctggccgatagccgcgaggcgaggggataagccatgaatggcgtactgctccgtcatcagcaacccggtggactcggccgcgctccgcgcaagccgatgccgcgcggcgccagccgtctggtggccaaggaaccgctgagcgtgcgcctgccgaaagccgacttcagtttcctcaagtacctggcctggccgctgttgctggccgttctcggctatggcgcctatcgcggcgccgagtacatcctgccgtacgccgaccggccgatcgccaaggtcagtgtcgagggcgacctcagctacatcagccagcgcgcggtgcagcagcggatctccccgtacctggcggcgagcttcttcaccatcgacctggcgggcatgcgcgggcaactggaacagatgccctggatcgcccacgccgaggtgcgccgggtgtggccggaccaggtggtgatccgcctggacgagcaactgccgatcgcgcggtggggcgacgaagcgctgctgaacaaccagggacaggcttttacgccaaaggaactggcgaattatgaacatctgccccgcttgcatggtccacagcgggcgcaacagcaggtgatgcagcaataccagttgctcagccagttgctgcgtcccctcgggttctccatcgcccgcctggaaatgagcgatcgcggcggttgggcgctgaccacggcccagggcgtcgagatccagatcgggcgcgaccacgtggtagacaagattcgccgcttcgtaagcatctacgacaaggcactcaaagatcagatttcgaacattgcgcggatcgacctgcgttaccccaacggcctcgccgttgcgtggcgcgagccggtcacgcccgcgacggtggccacggccagcgccgtgcagtgagttgaggagacagtaataaccatggcaagcgtgcagagcggcaagatgatcgtcggcctcgacatcggtacctccaaggtggtggcgctggtgggcgaggtgacggccgatggccagctggaggtcgttggcatcggtactcatccgtcccgcggcctgaagaagggcgtggtggtgaacatcgagtccaccgtgcagtcgatccagcgcgccatcgacgaggcccagcagatggccggttgccgtatccactcggcgttcgtcggcatcgccggcaaccacatccgcagcctcaattcccacggcatcgtggcgatccgcgatcgcgaggtgaacccggcggatatcgaacgggtactggatgccgcccaggcggtggcgatcccagcggaccagcgggtgctgcataccctggcccaggattacgtgatcgataaccaggaaggcgtgcgcgagccgctgggcatgtccggggtgcgcctggaagccaaggtgcacgtggtgacctgcgcggtgaatgcttcgcagaacatcgagaagtgcgtgcgccgctgcggcctcgaggtcgacgacatcatcctcgagcagttggcctcggcctattcggtgctgaccgaggacgagaaggaactgggcgtgtgcctggtggatatcggcggcggcaccaccgatatcgcgatcttcaccgaaggcgcgatccgccataccgcggtgatcccgatcgccggcgaccaggtcaccaatgacatcgccatggccctgcgtacgccgacccagtacgcggaagagatcaagatccgctacgcctgcgccctggccaagctggccggtgccggcgagaccatcaaggtgcccagcgtcggcgaccggccgccgcgcgaactgtcgcgccaggccctggccgaagtggtcgagcctcgttacgacgagctgttcaccctggtccaggccgagctgcgccgcagcggctacgaggacctgatcccggcagggatcgtcctcaccggcggcacctcgaagatggaaggcgcggtcgagctggccgaggaaatcttccacatgccggtacgcctcggcgtgccgtatagcgtgaagggcctcaccgacgtggtgcgcaacccgatctattcgacgggcgtcggcctgctgatgtacggactgcagaagcagtccgatggaatgtcgatgtctgtgtcaggcagcagctacagcagcgacgaacccaaggcacctgtcctggagcggctcaaacgctgggtccagggcaatttctgattcaacgcggtaacagtaggcgacaaaactagaaaggaaggagaggggaaatgtttgaactggtcgataacatcgcacaaaccgccgtcataaaagtgatcggtgtaggtggtggtggcggcaacgccgtcaatcacatggccaagaacaacgtcgagggcgtcgagttcatctgcgccaacaccgacgcacaagcgctgaagaacatcgcggcgcgcaccgttctgcaactcggcccgggcgtcaccaaggggctgggtgccggcgccaatccggaagtcggtcgtcaggcggctctggaagatcgcgagcgcatttccgaagtgctggaaggcgccgacatggtcttcatcaccaccggcatgggtggcggcaccggtaccggcgccgcgccgatcatcgccgaagtggcgaaggaaatgggcatcctcaccgtcgcggtggtgacccgcccgttcccgttcgaaggtcgcaagcgcatgcagatcgccgacgagggcatccgcgcgctggccgagagcgtcgattcgctgatcaccatcccgaacgagaagctgctgaccatcctcggcaaggacgccagcctgctggccgccttcgccaaggccgatgacgtgctggccggtgccgtgcgcggtatctccgacatcatcaagcgtccgggcatgatcaacgtcgacttcgccgacgtgaagaccgtcatgagcgaaatgggcatggcgatgatgggtaccggctgcgccagcggtccgaaccgtgcccgcgaggccaccgaggcggcaatccgcaacccgctgctggaagacgtcaacctgcagggcgcgcgcggcatcctggtgaacatcaccgcgggtccggacctgtccctgggcgagtactccgatgtcggcaacatcatcgaacagttcgcttccgagcacgccactgtgaaggtgggcaccgtgatcgacgcggacatgcgcgatgagctgcacgtcaccgtagtcgccaccggcctgggcgcgcgcctggagaaaccggtgaaggtcgtcgacaacaccgtgcagggcagtgcagcccaggcagccgctccggcccagcgcgagcagcagtcggtgaactaccgcgacctcgaccgtcctaccgtgatgcgcaaccagtctcacggcagcgcggcgaccgcggccaagctgaacccgcaggatgacctggattacctggatatcccggcgttcctgcgtcgtcaggccgattgaagtaattaatcaggagtagagatgtgattggtgttcagcaaaggccggttctgctatcatcgccggccattgttgaaaacagttcgcagtcagcgcttaagcggccaaagccatgatcaaacaacgcaccttgaagaacatcatccgggctactggcgtcggtctgcactcgggggaaaaggtttacctgaccctgaaaccggcgccggtggacaccggtatcgtgttctgccgcaccgacctggatccggtcgtggaaatcccggcccgggccgagaacgtcggcgaaaccaccatgtcgaccaccctggtcaagggtgacgtcaaagtggatacggtggagcacctgctctcggccatggccggcctgggtatcgacaacgcctacgtcgagctgtccgcttcggaagtgccgatcatggatggcagcgctggtccgttcgtattcctgatccagtccgccggattgcaagagcaggaagctgccaagaagttcatccgcatcaagcgcgaagtcagcgtggaagagggcgacaagcgcgccgtcttcgttccgttcgacggcttcaaggtcagcttcgagatcgatttcgatcatccggtcttccgtggtcgcacccagcaggcctcggtcgatttctccagtacttccttcgtcaaggaggtcagccgcgcccgtaccttcgggttcatgcgcgacatcgagtacctgcgttcgcagaacctggcactcggcggtagcgtggagaacgcgatcgtggtcgacgagaaccgcgtgctcaacgaagacggcctgcgttacgaggacgagttcgtcaagcacaagatcctggatgccatcggcgacctgtatctgctcggcaacagtcttatcggcgagttccgtggcttcaagtccggccatgccctgaacaaccaactgctgcgtacgttgatcgcagacaaggatgcttgggaagtggtgaccttcgaagacgcgcgtaccgcgcctatttcctatatgcgcccggcggcggcagtgtaggaaaactctcctttccatatttggaggccacctcagggtggcctctttttatttcgggatttattcttgccggcttttctcggcgcggcttgccaaccgctcgagcgcttcccgcaggcgtggattgccgacgatctcggcggattcgcgaaggttttccgccgcgacggcagacagggtcaagctgcgacgtgccgcacgttgtgtggacgtggtgggttgcaccttgaaaaggattttcgctaagttcgcgaattcttcgaaagcctgcagctgccgctgcaggcgccgctgctgatagcgcaggcgtgtggcccagtggccatcggtgacgatcagcagcaggcaaccgccgcgccacgaagccacatggcagtacgggcgcgccgccggttgcaactggctttccagcagttgctgcaggcggcagatgcgctgggcttcggcgaacagcatctgcagcggcctggcctggcgcagcaactgggtcgatgcctgggcgggcaagggacgaaaagacatggcgggaagcctgggggttactgagtcggaatggtagcagaaagcgtttcgctactgcyggcccgtatgaaggataagtcatgcacatcatttttctgagccggcaccatggggccgctcgctccgtccatctgcagccgcggttgctgatgctggccggggcctgcgtggtcggtgccagcctgttggccgggggcttcatgggcgcctggctgttccgcgcgccggctccggtggccggcatcgaagtcgatgccgcgctgcaggcgcagagcgccgagatcagcagcgcccgcgaggacgcgcagcggcagatggacgcactgagcgtgcatctcggcgaactgcaggcgcgcctggttcggctggatgccctcggcgaacgtctcaccgagctggccgacgtcgaccccgacgagttcgacttctccctgagcgtcggccagggtggcgtcgacgaaccgctggagggcagcgcctatgccccgccgtcgttcatggcgacgctggacgaactggcggcacgcctggatacccgcgagcagcagctcgaggtgctggagcaactgctcgccgacaagcacatcagccagtcgacctacctggccggccagccggtgcgccagggctacatctcctcgccgttcgggcgccgggtcaatccggtgagcggccgcctgagcatgcacaagggcatcgacttcgccgcgccggccggcagcgacgtggtggccgtggcggcgggggtggtgacctggtccgggcgcaagaacggctatggcaacgtggtcgaggtcgggcacgccgatggctacaccacgttgtatgcccataaccagaagaacctggtcgaggtcggtgacctggtcaagcgcggccaggtgctggccaaggtcggcagcaccggacgctccaccggctaccacgtacatttcgaagtgatgaaggatggccgggtaatgaatccgcaaagcttcatcgcacgcgcgtctgtttccgagtgagcgacgcgcattgatctgctgtacttttctcatacccgtttccgggtagaatgttccctttcatgccgttgatcggcacgggccgccggatgggtgagccttccattccccacgtgtggatgaccaagtcgatatgtttgcgcctttgttgaagaaactctttggaagcaagaacgagcgtgatgtaaagcgcatggccaaggctgtacaggccatcaatgcgctcgagccccagatggtggcgctctccgacgagcagttgaaggcgaaaacggctgaattccagcagcgctacgccaagggcgaaacgctcgaccaattgctgcccgaagccttcgccgtggttcgcgaggctggcaagcgggtgatgggcatgcgccacttcgatgtccagctgatcggtggcatgaccctgcacgacggcaagatcgccgaaatgcgtaccggcgagggcaagaccctggtgggcaccctgccggtctacctcaacgcgctgtccggcaagggcgtgcacgtggtcacggtgaacgactacctggcgcgccgcgacgccaactggatgcgcccgctgtacgagttcctcggcctcagcgtcggcgtggtcactcccttccagccgccggaagacaagcgcgccgcctacgccgccgacatcacctacggcaccaacaacgaattcggcttcgattacctgcgcgacaacatggccttcagcctggacgacaagttccagcgcgagctgaacttcgccgtggtcgacgaagtggactcgatcctcatcgacgaggcgcgtaccccgctgatcatctccggccaggccgaagacagctccgagctgtacatcaagatcaacaagctgatcccgcgtctcaagcgccaggttgaagaggtcgagggcaagccgaccgaggaaggccactacagcatcgacgagaagacccgccaggtcgaactcaacgagcagggccaccagttcatcgaggacctgctgagccagaacggcctgctcggcgaaggcgagagcctctactcggcgcacaacctgagcctgctgacccacgtctacgcagcgctgcgcgcgcacaccctgttccaccgcaacgtcgagtacatcgtccagggcgaccagatcctcctgatcgacgagcacaccggccgcaccatgcctggccgacgcctgtccgagggcctgcaccaggccatcgaggcgaaggaaggcttgccgatccaggccgagagccagaccctggcctccaccaccttccagaactacttccgcctgtacaacaagctggccggcatgaccggcaccgccgataccgaggccttcgagttccgccagatctacggtctcgacgtggtggtgatcccgacccaccggccgatcgcgcgcaaggacttcaacgacctggtctacctgacccaggaagagaagtacgcggcgatcatcaccgacatcaagcagtgccaggccctcggccggccgatcctggtcggcaccgcgtcgatcgagagttccgagtacgtttccaagctgttgcaagaggcaggcatcgagcacaaggtgctcaacgccaagtaccacgagaaggaagccgagatcatcgcccaggctggcgcgcccggttcggtgaccatcgccaccaacatggccggccgcggtaccgacatcctcctcggcggcaactgggaagtcgaagtcgcggccctggagaaccccaccgaggagcagatcgcccagatcaaggccgaatggcagaagcgccaccagcaggtgatcgaggcgggcggcctgcacgtgatcgcctccgagcgccacgaatcccgccggatcgacaaccagttgcgcggccgtgccggtcgtcagggcgacccgggttccagccgcttctacctgtcgctggaagacaacctgatgcggatcttcgcctccgaccgggtgaagaacttcatgaaggcgctgggcatgcagtccggcgaggcgatcgagcaccgcatggtgaccaacgccatcgagaaggcccagcgcaaggtcgaagggcgcaacttcgacatccgcaagcaactgctggaattcgatgacgtagccaacgagcagcgcaaggtgatctaccacatgcgcaataccctgctgtcggcagaggacgtgggcgagaccatcaaggaattccgcgaggaaaccctcagcgccaccatcaaccagcacattccgccgcagtcgctgcccgagcagtgggacatcgaaggcctggaggctgcgctgtacagcgacttcgccgtgcgcctgccgatccagcagtggctggacgaagacgacaagctgtacgaggaaaccctgcgtagcaagatcctcgagcagatcgtcgccgcctactacgagaaggaagagctggccggcgccgaagccctgcgcgccttcgagaagcagatgctgctgcgggtactggacgacctgtggaaggaccacctgtcgaccatggaccacctgcggcacggcatccacctgcgtggctacgcgcagaagaatccgaagcaggaatacaagcgcgagtccttcaccctgttccaggagctgctggactcgatcaagcgcgacaccatccgcgtgctgtcccacgtccaggtccgtcgcgaagacccggccgaagaggaggcccgcctgcgtcgcgaggcggaggaactggccaagcgcatgcagttccagcacgccgaggctccctcgatggagcaggccgtggccggcgaggaagaagagcttcccgagggcccggctccggtcgtgccgctcgagcctgtgcgcaacgagcagaagatcggccgcaacgagccttgcccgtgcggttccggcaagaaatacaagcactgccacgggcagctggactaagcttcccgcctggttcaccaacgccgcgaccggtcctgccgctcgcggcgtttgttcgaattggcgccagcccggcgccgatgcgttttccgtcacgccgtcgcggacggcatcgagtccactgtttggtaaaggagcgcgttcccatggctgtcggtcttggccccctgtccaccctgcacccggtccccggtttcgaactcggcatcgcttccgccggcatcaagcgaccggggcgcaaagacgtggtggtcatgcgctgcgccgaaggctccagcgtggccggggtgttcaccctgaacgcgttctgtgccgcgccggtgaccctggccaaacagcgtttcctcggtgaggtgcgctacctgctgaccaataccggcaacgccaacgccggtaccggcgaggccggcctcgccgccgctgcgcaaacctgcgccaagctcgccgaactggccggggtcgccgagacttcggtgctgccatattccaccggggtgatcggcgagcccctgccggtggccaagatcgaggcggcgttgcctgcggccctggccgacctggccgaggaccgctgggccgaagctgccgcggggatcc

SEQ ID NO: 16 - DNA, 1740 bp, Vibrio cholera
cggtgagcgacccaagaatttcactggtggtcatggtcaatgagccgcaaggcgactcttactatggcggcgcagtggccggtccggttttctcggaaatcatgaagggcgcattacaaatcctcaacattgctcctgatgaaaaccgcttccaaaacaaataatagtgtgagacggaacatgaacacgcattcagcgatctccgaactgatcgcgccatggctagagctgaccgaccctaagttggccgcgctggtcattactcatcttgaactggatagccgcctgattaaatcgggtgatacctttgtggctattcaaggccatgcagaggatggtcgccaatttatcgataaagccattgcgcaaggtgccaatcttgtgttggcagaggccgatgctcagcatctcaatgggtgggttgagtatcgtgctggtgtccccgtcatctatttggctgaacttggtcaacatctgtcagagttggctgggcgtctgtatggcggccaccacaatcaactgattggcgtgacgggcacgaacggtaaaaccaccatcacccagctgattgctcaatggctcgaattgctcggtcataaagctgccgtgatgggcaccacggggaacggttttttaaatgcgcttgaacctgcggccaacaccacaggtaacgcactgcaaattcaggccacactgcgcgatttagccgagcgcggcgcgcaatatacggcgctggaaacctcgtctcatggtttagtgcaagggcgcgtgaaaaagctccattttgtggccggtgtcttttccaatttgagccgtgaccatttggattatcacggcactatggaggcttacgccgccgcgaaattctctctatttagtgagcatgcctgccaaaacgcgattattaatgtcgatgatgcggtcggcgcgcaatgggtcaaacaattgccgcaggcgatcggggtttccttagtgacgaaaccaaacacagcgcaagccatctgggcgcgcgaagtggcatacgctgaaagcggtattacgctgaactttgagagttcgtggggagaaggcgaattgcacgcaccactgattggtgagttcaatgcctgtaacttgttattggcattggcaaccttgctcagcttgggttttgagaaaagtgcactgctcgccactgcgccaaagctgcgtccagtcttaggacggatggagctattccaacgtgagcaaaaagccaaaatggtggtcgattatgcgcacacgccggacgctttagaaaaagcactgcgcgcgttacgtgtacattgtgcgggtcagttgtgggctattgtggggtgtggcggcgatcgtgatcgcggtaaacgtccgatgatggctgcgattgctgagcagtttgccgatcgcgtgatcttgaccgatgacaacccacgcagtgagtcgccgcaagcgattgtagcggatatggttgcaggactgacttaccccgagcgcgctcatatcgaacaccaccgtttccaagccgcgagttatgcgcttcagcatgcaggtgcgcaagacatcatcctgctcgcgggtaaaggacatgaagattatcaggtgctggccaacgaaacgattcactactcggatcgtgaaaccgcccaacagttactggagttacaaccatgattcgcgtaatgctttctcagctcagctcagtattgaatgctcgtttaattggtgaggatcgcgcggtcagtg

SEQ ID NO: 17 - DNA, 899 bp, Vibrio cholera
aacctcttaaaaaacactgggtaattgtaaggctttcttttctaccgtgcaccgttgttttgtcacccaactcaccgtaaacaaactctatcttaggatgaataacctaggcaacagcgctacgatcttaaataaggaaccgataccgcttcaaattgagcaggataaacgggtaaatgcccgcatataacccatcagccagatttgacaaagccccctttcactcttcactatttcaatactgcgttatacccaaacgacttggagtttcaggtaggcggcaagtgagaaatcacatgagcatagataactatgtgattggtgatcaagtggagctgcacgaggcaacttcaagtaaagtaaaaaaggtaagttcgaatcaccgaacccgcttcacacaaggagtcaccatgagaattttaattactggaggaaccggatttgtcggttttcagctgataaagttgctcagtagtcatgagctgctggttctcacgcgtgacctaaccaaagccgctcagcgctttgcgcacattccaagtcagaatctgcaattactgtcgccgttagacgagctctctgatttcaacgggatagatgccatcatcaatcttcgaccggacaaccgattgccgataaacgctgaggaaaagccaaaagcaggtattgcccgtagtcgcctagacatcacggaacaattagtcgagaaaattcgagctagcgctcacccacccgccgtatttttgagtggatctgcctggtttttatgcgaccaacaagcagcatgcctgtgatgagagccttcagtaagaatgaccattttctcaccaatttgccaacatggaacagcgcgccctcaaagcacaatctgaacagacgcgcgggtctgtttattacgt

SEQ ID NO: 18 - DNA, 1550 bp, Neisseria gonorrhoea
ctggaaggaaacttgccgcaaccggaaaacggtacagtgcaagagagagaagggggcggcggtttgttggcaagattgaagcggtggattgaaaacaacctctgaacagttggattgccgtttgacaggtgagaagtattttgccagcagtaagatacttcttatataataaataataatttatttaaaccgtcctctgaacggggcgatcaggagtttttgaatggaatttgtttacgacgtggcagaatcggcagtcagccctgcggtaattaaagtaatcggcttgggcggcggcggttgcaatgcaatcaataacatggttgccaacaatgtgcgcagtgtggagtttatcagtgccaatacagatgcgcagtctttggcaaaaaaccatgcggcgaagagaatccagttgggtacgaatctgacacgcggtttgggcgcgggtgcgaatcccgatatcggccgtgcggcagcacaggaagatcgggaggccattgaagaagccattcgcggtgccaatatgctgtttatcacgaccggtatgggcggcggtaccggtaccggttccgcgccggttgttgctgagattgccaagtctttgggcattctgaccgttgccgtagttacccgtccgttttcttatgaaggcaaacgcgtccatgtggcacaggcagggttggaacagttgaaagaacacgtcgattcgctgattatcatcccgaacgacaaactgatgaccgcattgggtgaagacgtaactatgcgcgaagccttccgcgcggcggacaatgtattgcgcgatgcggtcgcaggcatttccgaagtggtaacttgcccgagcgaaatcatcaacctcgactttgccgacgtgaaaaccgtgatgagcaaccgcggtatcgctatgatgggttcgggttatgcccaaggtatcgaccgtgcgcgtatggcgaccgaccaggccatttccagtccgctgctggacgatgtaactttggatggtgcacgcggtgtgctggtcaatattacgactgctccgggttgcctgaaaatgtccgagttgtctgaagtcatgaaaatcgtcaaccaaagcgcgcatcccgatttggaatgcaaattcggtgccgctgaagacgagaccatgagcgaagatgccatccggattaccattatcgctaccggtctgaaagaaaaaggagcggtcgatcctactccggaaagggaagtagaagcggttgccccgtccaaacaggagcaaagccacattgtcgaaggtatgatccgcaccaatcgcggtatccgcaccatgaatctgacagcagcggatttcgataaccagtctgtccttgacgattttgaaattcctgcaattttgcgtcgtcaacacaattcagacaaataatgtgccgtctgccgtaaacttattgcctcccgaaccggttttcccgatttgggaggtatatttttcaatatgccgaatcctgtgcggtttgcggtgtgcgggttcagattttttacttgaaacggactgctagatatggatatttcaa

SEQ ID NO: 19 - DNA, 1101 bp, Staphylococcus aureus
gttaaattaaacatttttctgataaaaacatccagtgaatgataagataataaacgtacatactaataactagtaaatcgcaggagtaaattttattagagttaaacaatacataattaaagggtggttaacatgactaaaacaaaaattatgggcatattaaacgtcacacctgattcattctcagatggtggaaaatttaataatgttgaatcagcagtaactagagtgaaagcgatgatggatgaaggtgctgacattatagatgttggaggtgtttcaacgagacccggccatgaaatgattactgtggaagaagagttgaatagagtattaccagttgttgaagcgattgtcggttttgatgtaaaaatttcggttgatacttttcgtagtgaagttgctgaagcttgtttaaagctaggtgttgatattattaatgatcaatgggcaggcctttatgatcatcgcatgtttcaagttgtagccaaatacgatgcggaaattgttttaatgcataatggcaatggtaatcgtgatgaaccggttgtcgaagaaatgttaacatctttgttagcacaagcacatcaagctaaaatagctggtataccttcaaataaaatttggctagatccaggtataggtttcgctaaaactagaaatgaagaagccgaagttatggcaagactggatgaacttgttgcaacagaatatccagttttattagcgacaagccggaaacgtttcactaaagagatgatgggttatgatacaacaccggttgaaagagatgaagtaactgcagctacgactgcatatggtattatgaaaggcgttagagcagtacgcgttcataatgtcgagttgaatgctaaattagctaaaggtatagattttttaaaggagaatgaaaatgcaagacacaatttttcttaaaggtatgcgcttttatggatatcatggtgctttatcagctgaaaatgaaataggacaaattttcaaagtggatgtaactttgaaagtagacttatctgaagctggtcgtactgataatgttattgatacagttcattatggtgaagtgttcgaagaggttaaatc

SEQ ID NO: 20 - DNA, 3124 bp, Staphylococcus aureus
tggcttgattcaaactagtgaacaataaattaagtttaaagcacttgtgtttttgcacaagtttttttatactccaaaagcaaattatgactatttcatagttcgataatgtaatttgttgaatgaaacatagtgactatgctaatgttaatggatgtatatatttgaatgttaagttaataatagtatgtcagtctattgtatagtccgagtcgaaaatcgtaaaatatttataatataatttattaggaagtataattgcgtattgagaatatatttattagtgataaacttgttgacaacagaatgtgaatgaagtatgtcataaatatatttatattgattctacaaatgagtaaataagtataattttctaactataaatgataagatatattgttgtaggccaaacagttttttagctaaaggagcgaacgaaatgggatttttatcaaaaattcttgatggcaataataaagaaattaaacagttaggtaaacttgctgataaagtaatcgctttagaagaaaaaacggcaattttaactgatgaagaaattcgtaataaaacgaaacaattccaaacagaattagctgacattgataatgtcaaaaagcaaaatgattatttagataaaattttaccagaagcatatgcacttgttagagaaggctctaaacgtgtattcaatatgacaccatataaagttcaaattatgggtggtattgcaattcataaaggtgatatcgctgagatgagaacaggtgaaggtaaaacattaacagcgacaatgccaacatacttaaatgcattagctggtagaggtgttcacgttattacagtcaatgaatacttatcaagtgttcaaagtgaagaaatggctgagttatataacttcttaggtttgactgtcggattaaacttaaacagtaagacgacagaggaaaaacgtgaagcatacgcacaagacattacttacagtactaataatgagctaggttttgattacttacgagataacatggtgaattattctgaagatagggtaatgcgtccattacattttgcaatcattgatgaggtggactcaattttaatcgacgaggcacgtacgccattaattatttctggtgaagctgaaaagtcaacgtcactttatacacaagcaaatgtttttgcgaaaatgttaaaacaggacgatgattataaatacgatgaaaaaacgaaagctgtacatttaacagaacaaggtgcggataaagctgaacgtatgttcaaagttgaaaacttatatgatgtacaaaatgttgatgttattagtcatatcaacacagctttacgtgcgcacgttacattacaacgtgacgtagactatatggttgttgatggcgaagtattaattgtcgatcaatttacaggacgtacaatgccaggccgtcgtttctcggaaggtttacaccaagctattgaagcgaaggaaggcgttcaaattcaaaatgaatctaaaactatggcgtctattacattccaaaactatttcagaatgtacaataaacttgcgggtatgacaggtacagctaaaactgaagaagaagaatttagaaatatttataacatgacagtaactcaaattccgacaaataaacctgtgcaacgtaacgataagtctgatttaatttacattagccaaaaaggtaaatttgatgcagtagtagaagatgttgttgaaaaacacaaggcagggcaaccagtgctattaggtactgttgcagttgagacttctgaatatatttcaaatttacttaaaaaacgtggtatccgtcatgatgtgttaaatgcgaaaaatcatgaacgtgaagctgaaattgttgcaggcgctggacaaaaaggtgccgttactattgccactaacatggctggtcggggtacagatatcaaattaggtgaaggcgtagaggaattaggcggtttagcagtaataggtacagagcgacatgaatctcgtcgtattgatgaccagttacgtggtcgttctggacgtcaaggtgataaaggggatagtcgcttctatttatcattacaagatgaattaatgattcgttttggttctgaacgtttacagaaaatgatgagccgactaggtttagatgactctacaccaattgaatcaaaaatggtatcaagagctgttgaatcagcacaaaaacgtgtagaaggtaataacttcgacgcgcgtaaacgtatcttagaatacgatgaagtattacgtaaacaacgtgaaattatctataacgaaagaaatagtattattgatgaagaagacagctctcaagttgtagatgcaatgctacgttcaacgttacaacgtagtatcaattactatattaatacagcagatgacgagcctgaatatcaaccattcatcgactacattaatgacatcttcttacaagaaggtgacattacagaggatgatatcaaaggtaaagatgctgaagatattttcgaagtcgtttgggctaagattgaagcagcatatcaaagtcaaaaagatatcttagaagaacaaatgaatgagtttgagcgtatgattttacttcgttctattgatagccattggactgatcatatcgacacaatggatcaattacgtcaaggtattcacttacgttcttatgcacaacaaaatccattacgtgactatcaaaatgaaggtcatgaattatttgatatcatgatgcaaaatattgaagaagatacttgtaaattcattttaaaatctgtagtacaagttgaagataatattgaacgtgaaaaaacaacagagtttggtgaagcgaagcacgtttcagctgaagatggtaaagaaaaagtgaaaccgaaaccaatcgttaaaggcgatcaagttggtcgtaacgatgattgtccatgtggtagtggtaaaaaattcaaaaattgccatggaaaataaatgatataaaataactccttccaattaaacacctatagtttgtgttatgggaggagtctttttattttacaagcgttaaatactttaaaaaatgtgaagaagttgttaaacgttgttatgtacttagttttaaaaaatcggtttaggcatatg

SEQ ID NO: 21 - DNA, 12100 bp, Staphylococcus aureus
gaagtgactttattgagacaaacaagcctcacttcattttattgaaaaagggtagaaggtatgattgaacaacagcgtcgtctaaacaaagacttattagatgaagtggcggggaatcaaaataatattaaccttgtgaataaaaataatgaaattcatatacaacagtatgattatttgttaaaacgttatcttttaaacattgaaagagaaaacgacatcagtatgaagcaatttagagaaattcaagaaacactccatccattgggaggattacaagaaagaatatggaatccacttcaaattttgaatgattttgggacagatgtgttcaagccctccacctatccaccactttcttacacttttgatcatattattataaaaccttaatataccaagggtttagcccgatttatcttaatgataaatcgggcatttttttgttttttaaaataaatttcacaaattttgtataaatagtggtggatagtggggagatgtggtaaattatatataaggtgaggtgataaaaaatgttcatgggagaatacgatcatcaattagatacaaaaggacgtatgattataccgtccaagtttcgttatgacttaaatgagcgttttattatcacaagaggccttgataaatgtttattcggttacactctagacgaatggcaacagattgaagagaaaatgaaaaccttacctatgacaaaaaaagacgcacgtaagtttatgcgtatgttcttctctggtgctgttgaagtagaacttgataagcaagggcgtattaacatccctcaaaacttgaggaaatacgctaatttaactaaagaatgtacagtaatcggtgtctcaaatcgtattgagatttgggatagagaaacttggaatgatttctatgaaagaaatctgaagaaaagtttcgaagatattgctgaagatttaatagattttgatttttaaaatggaggaattgaagtgtttcatcatatcagcgttatgttaaacgaaaccattgattatttaaatgtaaaagaaaatggtgtgtacattgactgtacgctaggtggagcgggacatgccctttatttactaaatcaattaaatgacgacggaagattaatagcaatcgatcaagaccaaactgcaattgataatgctaaagaggtattaaaggatcatttgcataaggtgacttttgttcatagcaacttccgtgaattaactcaaatattaaaagacttaaacattgaaaaagtagatggaatttattacgacttgggtgtttcaagcccacaactcgacattccagaacgaggattcagttatcaccatgacgcaacattagacatgcgtatggaccaaacacaagaactaacagcatatgaaattgttaacaattggtcatatgaagcgttagtgaagattttttatcgctatggcgaggagaaattttcaaaacagatagctcgaagaatcgaagcacatcgcgaacaacaaccaataacaacaacattagaattagttgacattataaaagaaggtattcctgcaaaagcaagaagaaaaggcggacatcctgcaaaacgagtatttcaagcactacgaattgcagtaaacgatgaattgtcagcttttgaagattcaatagaacaagcgattgaattagtgaaagtagatggcaggatttcggtaatcactttccattctttagaagatcgtttatgtaaacaggtgttccaagaatatgaaaaaggtccagaggtaccaagaggattaccagttataccagaagcatatacacctaagttaaagcgtgttaatcgtaaaccgattaccgctacagaagaagatttagatgacaataacagagcacgaagcgcgaaattacgtgtagctgaaatacttaaataaggagcaatttataatggctgtagaaaaagtgtaccaaccatatgacgaacaagtttataatagtataccgaagcaacaaccacaaactaagcccgaaaagaagactgtttcgagaaaagtggttgtacaattaactaaatttgaaaaagttttatacataactttgattactgtaattgctatgttaagtatttatatgctatctttaaaaatggatgcgtatgatacgcgaggaaagattgcagatttagattataaaatagataaacaatcaagtgaaaacagtgctttacaatctgaaatcaaaaagaattcttcttatgaacgcatatacgaaaaggctaagaaacaggggatgagccttgagaacgataatgtaaaggtagtgcgtagtaatggcgaagcaaaaaattaaaattaaaaaaaataaaataggggcagtcctacttgttggtttattcggactgctcttttttatattggttttaagaatttcatatatcatgattactggacattctaatggtcaagatttagtcatgaaggcaaatgaaaagtatttagttaagaatgcacaacaaccagaacgaggaaagatatatgatcgtaatggtaaagtgctagcagaagatgtagaaagatataaacttgttgcagtaatagataaaaaggcgagtgccaattctaaaaaacctaggcatgtagttgataaaaaagagactgcaaagaaattatctacagtcattaatatgaagccagaggaaattgaaaagagacttagtcaaaagaaagctttccaaattgaatttggacgcaaaggaacaaatttaacgtatcaggacaaattgaaaatagagaaaatgaatttgcctggtatttctttattgcctgaaacagaacgcttttatccaaatggcaattttgcatcacacttaattggtagagctcagaaaaatccggatactggtgaacttaaaggtgcacttggagttgaaaagatttttgatagttatttaagtggatctaaaggatcattgagatatattcatgatatttggggatatatcgcaccaaatactaaaaaagagaagcagcctaaacgtggtgatgatgtccatttaacaatcgattcaaatattcaagtatttgttgaagaagctttagatggcatggttgaaagataccagccgaaagatttatttgcggttgtcatggatgccaaaactggagaaattttagcatacagtcagcgaccaacatttaatcctgaaactggtaaagactttggtaaaaagtgggcaaatgacctttatcaaaacacatacgagcctggatcaacatttaaatcatatgggttagcagctgctattcaagaaggtgcttttgatcctgataagaaatataaatctggacatagagatattatgggttcacgtatttcagactggaatagagtcggttggggtgaaatcccaatgtcactcggatttacttattcatctaatacattgatgatgcatttacaagatttagttggtgcagacaaaatgaaatcttggtatgaacgatttggatttggaaaatcaactaaaggtatgtttgatggagaagcacctggtcaaattggatggagtaatgagttgcaacaaaaaacgtcatcatttggtcaatcgacaacagtaacacctgttcaaatgttacaagcgcaatcagcgttctttaatgatggtaatatgttaaaaccatggtttgtgaatagcgttgaaaatcctgttagtaaaagacaattttataaagggcaaaaacaaatcgcaggcaaaccaataacaaaagatactgctgaaaaagttgaaaagcaattggatttagttgtgaatagtaagaagagtcacgctgcaaactatcgtattgatggttatgaggtcgaaggtaagactggtacagcacaagtcgctgcacctaatggtggtggatacgttaaaggtccaaacccatattttgtaagttttatgggtgacgcgccgaagaaaaatcctaaagttattgtatacgctggtatgagcttggcacaaaaaaatgaccaagaagcttatgaattaggtgttagtaaagcgtttaaaccaataatggaaaatactttgaaatatttaaatgtaggtaaatcaaaagatgacacatctaatgcagagtatagtaaagtgccagatgttgaaggtcaagacaaacaaaaagctattgataatgtgagtgcaaaatcattagaaccagttactattggttctggcacacaaataaaagcacaatctataaaagcagggaataaagtcttacctcatagtaaagtactgttattaacagatggagacttaactatgcctgacatgtcaggatggacgaaagaagatgtcattgcttttgaaaacctaacaaatattaaagtaaatttaaaaggtagcggttttgtgtcccaccaatcaattagtaagggacaaaaacttactgaaaaagataaaatagacgtagaattttcatcagagaatgtagacagcaattcgacgaataattctgattcaaattcagatgataagaagaaatctgacagtaaaactgacaaggataagtcggactaacaagaatggctacattaaattaggatgtattgtcactatttgtttttactaaagtaatgctgtgatagaaaacaacatcttcatttaatctttataaataagtgttgatagagaattttaaggtagacgaggtcagattaacttgtttgttataggcaaactttttatactggcctcttatgccgtaaaaaagaaaaattataaattttgattacaactttgtttatttaattgaaaaattgataatatattagtggttaaaaaatctggattaagaagaggagatagttatgatttttgtatatgcgttattagcgctagtgattacatttgttttggtacctgttttaatacctacattaaaaaggatgaaatttggtcaaagtattcgagaagaaggtccacaaagccatatgaagaagactggtacaccaacgatgggtggactaacatttctattaagtattgtgataacgtctttggtggctattatatttgtagatcaagctaatccaatcatactgttattatttgtgacgattggttttgggttaattggttttatagatgattatattattgttgttaaaaagaataacccaggtttaacaagtaaacagaagtttttggcgcaaattggtattgcgattatattctttgttttaagtaatgtgtttcatttggtgaatttttctacgagcatacatattccatttacgaatgtagcaatcccactatcatttgcatatgttattttcattgttttttggcaagtaggtttttctaatgcagtaaatttaacagatggtttagatggattagcaactggactgtcaattatcggatttacaatgtatgccatcatgagctttgtgttaggagaaacggcaattggtattttctgtatcattatgttgtttgcacttttaggatttttaccatataacattaaccctgctaaagtgtttatgggagatacaggtagcttagctttaggtggtatatttgctaccatttcaatcatgcttaatcaggaattatcattaattattataggtttagtattcgtaattgaaacattatctgttatgttacaagtcgctagctttaaattgactggaaagcgtatatttaaaatgagtccgattcatcatcattttgaattgataggatggagcgaatgggaaagtacttacagtattttgggctgttggtctgatttcaggtttaatcggtttatggattggagtgcattaagatgcttaattatacagggttagaaaataaaaatgtattagttgtcggtttggcaaaaagtggttatgaagcagctaaattattaagtaaattaggtgcgaatgtaactgtcaatgatggaaaagacttatcacaagatgctcatgcaaaagatttagaatctatgggcatttctgttgtaagtggaagtcatccattaacgttgcttgataataatccaataattgttaaaaatcctggaataccttatacagtatctattattgatgaagcagtgaaacgaggtttgaaaattttaacagaagttgagttaagttatctaatctctgaagcaccaatcatagctgtaacgggtacaaatggtaaaacgacagttacttctctaattggagatatgtttaaaaaaagtcgcttaactggaagattatccggcaatattggttatgttgcatctaaagtagcacaagaagtaaagcctacagattatttagttacagagttgtcgtcattccagttacttggaatcgaaaagtataaaccacacattgctataattactaacatttattcggcgcatctagattaccatgaaaatttagaaaactatcaaaatgctaaaaagcaaatatataaaaatcaaacggaagaggattatttgatttgtaattatcatcaaagacaagtgatagagtcggaagaattaaaagctaagacattgtatttctcaactcaacaagaagttgatggtatttatattaaagatggttttatcgtttataaaggtgttcgtattattaacactgaagatctagtattgcctggtgaacataatttagaaaatatattagcagctgtgcttgcttgtattttagctggtgtacctattaaagcaattattgatagtttaactacattttcaggaatagagcatagattgcaatatgttggtactaatagaactaataaatattataatgattccaaagcaacaaacacgctagcaacacagtttgccttaaattcatttaatcaaccaatcatttggttatgtggtggtttggatcgagggaatgaatttgacgaactcattccttatatggaaaatgtttcgcgcgaatggttgtattcggacagccgaaagctaagtttgctaaactacggtaatagtcaagggaaatcggtcattgaagcgaacaatgtcgaagacgctgttgataaagtacaagatattatagaaccaaatgatgttgtattattgtcacctgcttgtgcgagttgggatcaatatagtacttttgaagagcgtggagagaaatttattgaaagattccgtgcccatttaccatcttattaaagggtgtgagtattgatggatgataaaacgaagaacgatcaacaagaatcaaatgaagataaagatgaattagaattatttacgaggaatacatctaagaaaagacggcaaagaaaaagatcaaaggctacacatttttctaatcaaaataaagatgatacatctcaacaagctgattttgatgaagaaatttacttgataaataaagacttcaaaaaagaagaaagcaatgataaaaataatgattctgcttctagtcatgcgaatgataataatatcgatgattctacagactctaatattgaaaatgaggattatagatataatcaagaaattgacgaccaaaatgaatcgaatgtaatttcagtcgacaacgaacaacctcaatcagctcctaaagaacaaaatagcgactcgattgatgaggaaacagtaacgaaaaaagaacgaaaaagtaaagtaacacaattaaagccattaacacttgaagaaaagcggaagttaagacgtaagcgacaaaagcgaatccaatacagtgttattacaatattggtattgttgattgctgttatattaatttacatgttttcaccacttagtaaaattgcgcatgtaaatataaatggaaataatcacgttagtacttcaaagataaacaaagttttaggtgttaaaaatgattcaaggatgtatacgtttagtaaaaaaaatgctattaatgatctcgaagagaatccattaatcaaaagtgttgagatacacaagcaattaccaaacacattaaacgtagatatcacagaaaatgaaattattgctttagtgaaatataaaggtaaatatttacctttattagaaaatggtaaattgcttaaaggttcaaatgatgtcaaaattaatgatgcacctgtcatggatggtttcaaaggtacaaaagaagatgatatgattaaggcgttatctgaaatgacacctgaagttagacgatatattgccgaagtgacatacgccccaagtaaaaacaaacaaagcagaattgaattgtttacgacagatggacttcaagtaatcggtgatatttcgacgatatctaagaaaatgaaatattatccgcagatgtcacaatcattatcaagggatagttcgggtaaactaaaaacacgaggctatattgatttatcagtcggtgcttcatttatcccataccgtggaaacacgtctagtcaatcagaaagcgataaaaatgtgactaaatcatctcaagaggaaaatcaagcaaaagaagaattacaaagcgttttaaacaaaattaacaaacaatcaagtaagaataattaaaaaattttgatattgtctatgtttatagttcacaagccattcaacgtattgtaaactaaggatagtgtatttttttaatagtaatttgtcaggaggtgcctatctatggaagaacattactacgtaagtattgatattggatcatcaagcgtaaaaacaatagtaggcgagaaatttcacaatggtataaatgtgataggtacaggacaaacctacacgagcggtataaaaaatggtttaattgatgattttgatattgcgcgacaagcaatcaaagacacaattaaaaaggcatcaatcgcttcgggtgttgatattaaagaagttttcctgaaattacctatcattggaacggaagtttatgatgaatcaaatgaaatcgacttttatgaggatacagaaatcaacggttcacatatcgaaaaagtattagaaggtattagagaaaaaaatgatgtgcaagaaacagaagtaattaatgtgttcccgattcgttttatagtcgataaagaaaatgaggtttcagaccctaaagaattaattgccagacattcattaaaggttgaagcaggcgtaattgctattcaaaaatcgattttaattaatatgattaaatgcgtagaagcatgtggtgttgatgtattagatgtttactctgatgcatataactatggttcaatcctaacagctactgaaaaagagttaggtgcatgtgtcattgatattggtgaagacgttacgcaagttgctttttatgaacgcggtgaattagtagatgctgattctatcgaaatggcagggcgtgatattacaagacgatattgcacaaggattaaagcacttcttatgaaactgctgaaaaagttaaacaccaatatggtcatgcattctatgattctgcttcagatcaagatatcttcactgttgaacaggttgatagtgatgaaacagtacagtatacctcaaaaagatttgagtgactttattgaagcgcgtgtagaagaaatattcttcgaagtatttgatgttttacaagatttaggattaacaaaagtaaatggtgggtttattgtaactggtggatctgcaaacttacttggcgtaaaagaattattatcagatatggtaagtgaaaaagttagaattcacacgccatcacaaatgggaattagaaaacctgaattttcttcagcaatttctacaatttctagtagtatcgcttttgatgagttattagattatgttacaattaattatcatgataatgaagaaactgaagaagatgttattgatgtgaaagacaaagataacgaatctaaattaggcggatttgattggtttaaacgtaaaacaaacaaaaaagatactcatgaaaatgaagtagagtcaacagatgaagaaatttatcaatcagaagataatcatcaggaacataaacagaatcatgaacatgttcaagacaaagataaagataaagaagaaagtaaattcaaaaaactaatgaaatctctatttgaatgattattggccaataaaactaggaggaaatttaaatgttagaatttgaacaaggatttaatcatttagcgactttaaaggtcattggtgtaggtggtggcggtaacaacgccgtaaaccgaatgattgaccacggaatgaataatgttgaatttatcgctatcaacacagacggtcaagctttaaacttatctaaagctgaatctaaaatccaaatcggtgaaaaattaacacgtggtttaggagcaggagctaatcctgaaatcggtaaaaaagctgcagaggaatctcgtgaacaaattgaagatgcaatccaaggtgcagacatggtatttgttacttctggtatgggtggcggaactggtactggtgcagcaccagtcgttgctaaaattgcaaaagaaatgggcgcattaactgttggtgttgtaactcgtccatttagttttgaaggacgtaaacgtcaaactcaagctgctgctggagtagaagctatgaaagctgcagtagatacattaatcgttataccaaatgaccgtttattagatatcgttgacaaatctacgccaatgatggaagcatttaaagaagctgacaacgtgttacgccaaggtgtacaaggtatctcagacttaatcgctgtttctggtgaagtaaacttagactttgcagacgttaagacaattatgtctaaccaaggttctgcattaatgggtattggtgtttcttctggtgaaaatagagcggtagaagctgctaaaaaagcaatctcttctccattacttgaaacatctatcgttggtgcacaaggtgtgcttatgaatattactggtggcgagtcattgtcattatttgaagcacaagaggctgctgatattgtccaagatgctgcagatgaagacgttaatatgattttcggtacagttattaatcctgaattacaagatgagattgttgtaacagttattgcaactggttttgatgacaaaccaacatcacatggtcgtaaatctggtagcactggattcggaacaagcgtaaatacttctagcaatgcaacttctaaagatgaatcattcacttcaaattcatcaaatgcacaagcaactgatagtgtaagtgaaagaacacatacaactaaagaagatgatattcctagcttcattagaaatagagaagaaagacgttcaagaagaacaagacgttaatcggttaatatatatacacaaataattcaacacaaatcatcagataacatatctgatgatttttttactaatttttagaacatgtagaaggacatttaagtttttcaaagttattaaaagtgtttaagtatcgtgtgaaaattaagtcaaaaattatttacgcaacattttaactttaaacataaatgttatattatataattattaactttgtacagttagacgaagataattttaaaatgaaaatgatggtgacgatcgagttgtgataattttaaaaagcaaccgcatcatttaatatatgaagagttattacaacaaggtattactctaggtattacaactagaggagatggtttaagtgactatcctaaaaatgcttttaatatggcgagatatattgatgatcgcccatataatattactcaacatcaattgcaattagctgaagaaattgcgtttgatagaaaaaattgggtgtttcccattcaaacacatgaaaataaagtcgcttgtattacaaaggatgatataggcacaaatatagacactttaactgatgcgcttcatggtattgatgcgatgtacacatatgatagtaatgtcttattaacgatgtgttatgcagactgtgtaccagtatatttttatagtacaaaacatcattttattgcattggcgcatgcaggttggcgtggtacctatactgaaattgtaaaagaagtgctaaaacatgtgaactttgatttgaaagacttacatgtcgttattggaccatctacatcatcaagttatgaaattaatgatgatattaaaaataaatttgaaacattgccaattgatagtgccaactatattgaaactagaggacgagat

SEQ ID NO: 22 - DNA, 12100 bp, Staphylococcus aureus; identical to SEQ ID NO: 21

SEQ ID NO: 23 - DNA, 1314 bp, Staphylococcus aureus
atgacacactatcattttgtcggaattaaaggttctggcatgagttcattagcacaaatcatgcatgatttaggacatgaagttcaaggatcggatattgagaactacgtatttacagaagttgctcttagaaataaggggataaaaatattaccatttgatgctaataacataaaagaagatatggtagttatacaaggtaatgcattcgcgagtagccatgaagaaaaagcacgtgcacatcaaatgaaattagatgttgtaagttataatgattttttaggacagattattgatcaatatacttcagtagctgtaactggtgcacatggtaaaacttctacaacaggtttattatcacatgttatgaatggtgataaaaagacttcatttttaattggtgatggcacaggtatgggattgcctgaaagtgattatttcgcttttgaggcatgtgaatatagacgtcactttttaagttataaacctgattacgcaattatgacaaatattgatttcgatcatcctgattattttaaagatattaatgatgtttttgatgcattccaagaaatggcacataatgttaaaaaaggtattattgcttggggtgatgatgaacatctacgtaaaattgaagcagatgttccaatttattattatggatttaaagattcggatgacatttatgctcaaaatattcaaattacggataaaggtactgcttttgatgtgtatgtggatggtgagttttatgatcacttcctgtctccacaatatggtgaccatacagttttaaatgcattagctgtaattgcgattagttatttagagaagctagatgttacaaatattaaagaagcattagaaacgtttggtggtgttaaacgtcgtttcaatgaaactacaattgcaaatcaagttattgtagatgattatgcacaccatccaagagaaattagtgctacaattgaaacagcacgaaagaaatatccacataaagaagttgttgcagtatttcaaccacacactttctctagaacacaagcatttttaaatgaatttgcagaaagtttaagtaaagcagatcgtgtattcttatgtgaaatttttggatcaattagagaaaatactggcgcattaacgatacaagatttaattgataaaattgaaggtgcatcgttaattaatgaagattccattaatgtattagaacaatttgataatgctgttgttttatttaagggtgcaggtgatattcaaaaattacaaaatgcatatttagataaattaggcatgaaaaatgcgttttaa

SEQ ID NO: 24 - DNA, 12100 bp, Staphylococcus aureus; identical to SEQ ID NO: 21

SEQ ID NO: 25 - DNA, 7791 bp, Staphylococcus aureus
  misc_feature (1)...(7791): n = A,T,C or G
gtcgacgcggccgcgtaatnnaacnccntnnangggaaagaattcacgacgcttacgtcggtactgacttttaggaattacatgttttttaccaatatccactaatgtccactccattcaataaaatcacttatcattatgacacattaacacctaatttgctttaaaatctatataatttctattgaaaaaatgctaaatataaaaggcacattttcttaatactatatcgcatcttttgattcacattcttcaaaatccatttttcataaatcactcaattaaatgaaaaaggacaaccttaaactaaattaagattgtccgcttcacatcaattatttatgcgattttttatttttaacaactgaacctaaccaaccgataattactaatccaattagtactgtccagaaaatanattgccataatacgccatgtgggaagtgctcaggcaatacancgatgtctgggtgcgctaataccatgacactaatttaacacctacccaaccaacgatcgcgaaggcgccccttcaagtcctggatattgtttaatanctctacaaaccatgttgctgcataacgcattaaaataacacaatcattccncctaggaacatgactacaactggacctaattccntacccccaaantnaataccaactttaggaagtgttacagcaatagctaaagcagcaagcatagaatcaatggcaaatgcgatatctgcaaattctattttcaacacagttccccagaatgatttgttacttgctttaatctcttcaccagattcatcataatgatgatcatctccagcttcaggactttcaatttctgggtgtttaaagaactgccacnnatttttgattgacatataaattaagtaaaccgctcctgcagcttgaataaaccaaaagttcgcgataatactaattaagaataatgctaaaaatctaaatacaaatgcacctaacaaaccgtaaaacaaagcttttttacgttgttcgggtggtaagtgcttaaccattacagccataacaacccgttatctgctgctaataagccttctaaaaatactaaaacgacaagtacccataaataaggtaagatcaaacttggatccattaacatgtacaactcctttaaataaataagttaagtacaaacaaaaagacctatgctaaataaatagcaaaggtctcactaagcaatttaattgcccactttaccggaagatatcttcgtaatgacgataaagtgtcgaatcatttatacggtcatgattcttaagttactcccctctgacaaaatgccataggttattcatttgatacatcatagtatacctttttcttttaaaatatacaatttatttttcttcaacgaaacaattatttttaatgtaacaaattcgattatacaattgagctgttaaagtaaactatacaatttaatttcagggaatttctcttcaaaccatcttgttgcaaattcattttcaaataagaatactaaatcgtcatatctatctttcactaaaatcgatcttgatgtgttcatcttatctgtaatttggtcttcattttcaatgtcccaacgtgcaattttacggcctactggctccataacaacatcaacattatattcgtttttcattctatgttcgaaaacttcaaattgtaactgaccaacagcacctaaaataatttggtttgtgtgtaatgttttatagtattgaatcgcaccttcttgtactaattgttcaatacctttatggaaatgcttctgtttcatgacgtttttagcagaaactttcataaaaatttctggcgtaaattgtggtaaatcttggaaactgtaggtttgttttccaccaactaaagtatctccaatttgataattaccagtatcatatagtccaatgatatcgcctgctacagcatgattcaccagtttctttatcgtctgccataaatgacgttgaacgtgtgatcttttgctttttattagtacgttgcaaagtaacatccatacacgttcaaatgcaccactaacgacacgcataaaggcaattctatcacggtgtttagggtccatgttggcttgaattttaaagataaatcctgaaaatgaatcatcaaacgggcttacttcaacgttttcttttgtttgtctcgcatttggcatgggcgcaaaatcaacatatgcatttaagaaattttgtacaccaaagttagctaaagctgaaccgaaaaatacaggtgttaagtctccactcaacagcgcgtcattatcaaaggcttcacccgcttcttcaaccaacattaattcttcaatcgcttgttcaaaatcactatcatttgtaattgcatgatcttcttccaactcaaaatcatcattcaaatgtaatatattttcttcatctctaaatggttcaattgttttagactttctatcaatgatgccaaagaaactttgtcccataccaattggccaattcatagggtatgtttcaatatttaatgtctcttcgatttcatctaataattcaaatggttctttacctactcggtctaatttattaatgaatgtaaagattggaataccacgcattttacaaactttaaataatttcaangttggnggttcaacaccttttgcacagtctatgaccatgacagcactgtcaactgccattaatgttctatangtatcttcngaaaagtcttcatgtcctggggtatctaagatattgatttcataatcatcgtaatcaaattgcattactgaactagttacagaaataccacgttcttgttcaactttcatccaagtcacttgtcgcaaatttaccagtttcttccctttaactgtacccgcttcacgaatagcaccactgaagtacaatagtttttcagttaacgttgttttccctgcatcgggatgtgaaataatcgcaaaagtctttctagactcaacttcttgctttaagttcattagtctttctcctttttatatgtttctatccaatctgttagttgtgatgcaatcgattctgcttcttcttcttctttaaaaacaaacaattgcatgagtattgcttcaaaacaagtttcttcatctaatgtcattgccatctgatatgaccaaaaccaatctggtatagcaatgattatctggttatttaatgcttcgaataaataaacatcaatagttttaccttcatcaataaatcttttattaatcaacagggccaccaccgaactttttgtaagctgcttcaaggccaattaaatcatctcgatgtggcaccttaatatgccctggcatgatttgatatggttctcttccttttgatgctaaaacgacagtatccccaggctcagctatgtcaattgcatgttttatcccttctgcacgatcatcaaattcaatatagttttgatgtgttgcacctttggctaattctgccgttaacattttcgggtcatcatttgccggattatccggtgtgaaaatgacataatctgcacgacaggcaactcgccccatttcaggcgttttagttaaatcacgttcgcctgccataccaactaaaaatatcaacttttgctttacaaaaggctgtactgcatcgattaatttgttcataccatcagctgtatgtgcataatcgataattaaatcaataggtaacgaaggatctaaaacttctaatcgcccttcaacaggttctaaattttcaacagctttaataatcgtttctaaagatgtacctttactccacaccgcaatcattgccgccataatattagaaatattaaacttaccaacataaggcgattttactgggtaagttccaaaaggcgttacaaaatcaaagctgacaccttgtaaagattcttgaatatttttagccataaattgggcttcctcatcaattccataactaaatacttcataaggcgtcactgttcttaaatactcagaaaatgaatcgtcattgtttaacacgacatacttttctttcgacaaatcttcacctaattgactaaacaataaagacttcgcgtgtccgtatgcttccattgtgccatgaaaatctaaatggtcttgtgttaaatttgaaaatattgcaacgtcaaattcaacgcttcgcagtcgtcctaatactaagccatggcttgatacttctaatgtcatagattcagcgcctgcatcaactgcttctttaattttcttagttaaagaaactgtttctggtgtcgtatttgcaccttttgtctttgtttcattaatttggaaaccattagttcctaaatatgcactatttttttgtaactttctttgaattaaatgaatcatcgtcgcaatagaagttttaccatttgtacccgttacaccaaatgtcactaactgatgactcggataatcatataatgtgtgtgctagaatactagctactcttaatgtgtccggcacaaccacttgtgttacgttagctggtaatgattgttctttattgaccactaccaacttacacccttgatcagctacattttgacagaacttatgactgtctacagtatatccaactgaagcgacaaaaatgctaccttctctcgctgtacgtgaatcagtagtgatatcatctatttgttgttctaaagaacccaatacacgctttacttttactttctttaaacaacgtacttgcatccaaactgaaccgctcctttttctacaatatgtttattatacacgttttgttgatgttaataaatttataatttcactgttatatcctactaatcagcattttctaatttctactattaaaaataaaacatacggtattatgaattagttttacaattatggctcatcttaaattattaaaaccatcttgtaacatggtataatatcataattgtttccaaaaatatgctataattgtatactggataattttaaatatacaaataaaacatagaacaataaattgctttataaaataacgttttattttgtatcaattcatctatagattaaaattgctataaatgtaacgactttgcgtctttatttcttttataatgccgtaaaataagttacacttaaataaaattttcaaactaacgggagggtggctattaatggttactcaaaataaaaagatattgattattactggctcattcggtaacggtcatatgcaagttacacagagtatcgttaatcaacttaatgatatgaatctagaccatttaagcgtcattgagcacgatttatttatggaagctcatccaattttgacttctatttgtaaaaaatggtatatcaatagctttaaatattttagaaatatgtacaaagggttttattacagccgcccagataaactagacaaatgtttttacaaatactatggacttaataagttaattaatttattgataaaagaaaagccagatttaatattattaacgtttcctacaccagttatgtcggtactaactgagcaatttaacattaatattccagttgctacagtgatgacagactatcgcttacataaaaactggattacgccgtattcaacaagatattatgtggcaacaaaagaaacgaaacaagacttcatagacgtaggtattgatccttcaacagttaaagtgacaggtattcctattgataacaaatttgaaacgcctattaatcaaaagcagtggttaatagacaacaacttagatccagataagcaaactattttaatgtcagctggtgcatttggtgtatctaaaggttttgacacgatgattactgatatattagcgaaaagtgcaaatgcacaagtagttatgatttgtggtaagagcaaagagctaaagcgttctttaacagctaagtttaaattaacgagaatgtatttgattctaggttataccaaacacatgaatgaatggatggcatcaagtcaacttatgattacgaaacctggtggtatcacaataactgaaggtttcgcccgttgtattccaatgattttcctaaatcctgcacctggtcaagagcttgaaaatgccttttactttgaagaaaaaggttttggtaaaatcgctgatactccagaagaagcaataaaaattgtagcaagtttaactaacggtaatgagcaattaactaacatgattagtacaatggaacaagataaaattaagtatgctacacagacaatatgtcgagacttacttgatttaatcggtcattcatcacaaccacaagagatttatggaaaggttcctttatatgcaagattcttcgttaaataattacgctaatcataaaaatttcattttaatgcttattatcttatttttaatggaatttgcgagaggcatgtatatcctaagctatattaatttcttgccaacagttacatccattgctgtagcaataacgtctctagcattttcaatacattttattgctgatgcatctacaaactttgttataggatttttactgaaaaaattcggcacaaaaatcgttttaacgactggatttattttagcattatcaagtttatttttagttatttggtttccagcatcaccttttgtaatcatatttagtgctatgatgctcggtattgcagttagtcctatttgggtcattatgttatccagtgttgaagaagataaacgtggcaaacaaatgggctatgtttatttttcatggttgttaggcctattggtaggtatggtttttatgaatctacttatcaaagtgcacccaacacgctttgccttcatgatgtctttagtcgttttaattgcatggatattatattattttgtcgatgtaaagttaacaaattataatantcgtccagttaaagctcaattgagacaaattgttgatgtgacaaagcgccatttattgttgttcccctggtattcttttacaaggtgccgcaattgctgccctagttcctatattaccaacatatgctactaaggttattaacgtaagcacaattgaatatactgttgcaatcattattggtggtatcggctgtgcagtttcgatgctatttttatcgaaactaatagataaccgcagcagaaactttatgtatggtgttattctaagcggatttattttaaacaggatattaatttttaattctatcnangatggttaatattcacatcttgtggattatcgctttagctatcggtctaatgtanggcatcttattaccagcatggaatacctttatggcacgatttatcaaatcagtgaaccaggagaaacttggggtgtttttaatagtatcccaaggattcggctcaatgatagggccattatttggcggattaattacacaatttaccaacaatttaaacaatacattttatttctcggcattaatctttttagtcttagctgtattttatggaagctactttatagtaaatagagaaaaagctaagtaaggttaaaacgtattttaaaataaagaaaatggtcatttttattacattcaataaaaatgaccattttcttattaattcaaacatactacgattaacaatactattatgttacttaagctaatttaaacgtttcaataactttccatttatcttcgtcatcgtcaaaacgtaacaaagttaattcatcgataatttctttatggtctaccccagctaatgctacttgaccaaaaatatcttcgaattcgttccctttagtgagggttaattccgcggccgcgtcgac

SEQ ID NO: 26 - DNA, 12100 bp, Staphylococcus aureus; identical to SEQ ID NO: 21

SEQ ID NO: 27 - DNA, 37586 bp, Mycobacterium tuberculosis
actctaaacggcccggtgactccagcctttctgagcagcccgcgcgccgatcagcgccacgcgtcggcgatggcaccgagcaggatcggcgccacctcggctcgacacatcagcagatccggcaggtaggggtccagttggttgtatcgcagcggcgagccatcgagtcgtgacgcgtgcatgccggcggccaacatcaccccagccggcgccgcggaatcccactcccattggcctccggcgtgcaggtaggcgtcgacgtagccgtcaatgacggccatcgctttggcgcccgccgaaccgatcgacaccggttggatcgccagcgtctggcggatgcggtgcaggactgccggtggccgggtggcgctgacggcaatccgcaaggtgccaggaacgccggccggcgcggcgccggaagtcaccgtatcggtgcggtacaccacgttgccacgggccggcaacgccaccgcggcgtcggtgatctcgggctggccattggaggaacgccgccacagcgcaatgtgtaccgcccagtcgtcgcgacccggtgtggagaactcgcgggtgccatccaacgggtcaataatccacacccgatcggatttcagccgggccagatcgtcgtgggcctcctcactgagcactgcgtcacccggccgttcggcctgcagccgtcgcaacagcagcgagttagcctggcggtcaccggcttccccgagcgtccatggctgatcgaaaccgatctccgcacgcacctggagcaacagctttcccgcgtccgccgccaggtcggcggccagctcggcgtcagtcaggtcgtccgtcagatcaggtgcggcagggctcaccacttcagtatcgccgagctgaacgcaggcatttgacaatggggcttcacatcatgatgctctataattcgcatcttgatgcacaatagtgggatgcgaaccacggtcagtctcgccgacgacgttgccgctgccgtgcagcgcttgcggaaggaacgctcgatcgggctgagcgaagccgtcaacgagttgatccgtgccgggctcacgaaacgacaggtcgcaaatcggttccagcagcagacgtacgacatgggcgagggaatcgactactccaacatcggcgacgcgatcgaaacactggacggcccggcaagcggctaatgctcattgacgcaaacctcctgctctatgccgtcgacgagcgtgccgcgcggcaccgcgccgcggttggctggctttcggaacaactcaacggctcccgtcgggtcggcttgccgtggcagagcctggccgccttcctgcggatcgggactcatccacgtgcgttcccgcgaccactcacacctgccgcggcattcgacatcgtcgacctaaaacgccggccagggaatgggacgatgcccattcggcccgggcatcaccggttggtccagcagcgattgcgcgcgtcggcgcagcgcgccgatttcggctgcggcgattcgcccggccaacgcctcggcaagcgggccgccaagagcatcggcgagcccggcaaccgcctgcagaatttggtcgtcaatcggcttgccggcccaaccccacagcacggtgcgcagcttgttctcgacgtgcagacacaatccatggtcgaccccgtagacctggccgtcgatgccgcacaggatgtgaccgcccttgcggtcggcgttgttgataagcacgtcgaacaccgccatccggcgcaaccggatgtcgtccgcgtgcatcaaaacgacctcgtcaccggcgtagtcgtaggcccgcagcaccggcagatagcccggccgcggccggtgggcgggaaacaggtcgaccaggtcgggcccgggcagagggtcggagtcgaccgcgtcgccgggttgctgcacccagagctgtagcatgcctatgcccgccggaccgtctcggatgatggtgtgcggcaccaggttccagcccaactgtgtcgacaccagataggcgctgagttcgcggccggccagcgttccgtcggggaaatcccacaacggccgctcgcccgagaccggcttgtagacgcaatgcaggctgcgcagacccagcgtggactcacacaaaaaggtggcgttgctcgccgagcggatccgcccgaggactgtcagctcgccgtcggccaacaccgcatgctcgtcatcccgcagggtcatcgccagacccgagcagcacatcgcgccggtaaccgttggtgcgcgcacagatgtgtccctcgggatccagcggttcatcgcagagcgggcacggcgggcgtcccgcagagatgacgcggtaggaccgagtagcgaactgtcgggcggactccggcgtcagaaatacccgcaccgcgtcgggcccttcctcggtgtcgtcgagcaccacggaagcgtcgaactccgcgtcggtgacggccagcagttcgaccaccacgctctgcgcctccgaatcccagcccagccccatcgtcccgacccgaaactcggcatccaccggcatgatcagggggctgaggtcgtcgatctcagtgggttccgggggcaccggggtgccgaaccggcggttaacctcgaacagcagcgctccgatgcgctcggcgagcaccgcaacctgctgcttctccaggaccaccgacaccacccgggagtcgtgcaccgcctgtaggtagaacgtgcggtttccgggctggccaacagtcccggcgacgaaacggtcgggtgtgcggaatacgtgaattgcgcgggccatggcacctccaaaataccgcgcagacgccgttgccgcgttcttcgtcgacggtcaccccacacgctagtcggtggaaccgccgatcaccgcgtcgccgggtggcaccgccgcgttcggctccggtgacgcaccctgggcggaagccgcggcctgcaaagccggggccagccgggcgccggtgtggttgacgtgcagcacgaacgggcgcagctgggtgtagcggacgacactcaccgaacccgggtcggcggtgattcgctgaaagctgtccagatgcataccgaacgcgtctgcgatcaccgccttgatgacatcgccatgggtgcaggccagccacagcacgtcgtggccgtgctgatcggccagccgccggtcgtgttcgcggacggctgccacagcgcgagtctgcacctgcgccaaaccctcaccgccgggaaacaccgccgcgctggggtgggcctggactacccgccacaacggctcgtcgaccaggtcaccgatttttctgccagtccattcgccgtagtcgacttcggagaaccggtcatcgatgagcggctccaggcacagcgcctcggccagcggttcgacggtgcgttgacaccgcagcattggagaagacgcgaccgcccggatcggcaggtcaccaattcgatcgatcaacccggtggcctgctcgcgccccttctcgtcgaggtcgacgccggaccggccggccagcacgcccgcggtgttcgaggtggaacgggcatggcgtagcaagatgacggtcatgtcgcggctaccgtcccggtagccagcagcacgagcatgcccgtcccgacgagcacccggtagccgacgaaccagtacatgttgtgtcgcaccagaaaccgcagcagccaggccaccgcggtcagaccgaggacgaacgcgatcagggtggccaccagcaactgcgggccagtagcgctcatgccctcggttaccgggtggaatgcgtcgggcaacgagaacaacccggaggcgaacaccgctggaatggccagcaggaatccgaatcgggcggccagttcacggtcgagtccgagaaacagtccagcgctgatggtcgacccggacctggataccccggggaccagcgccagggtttgggcaataccaaccaccacggcatcccgccaggtcaaccgctcaatgtgacgactctggcgccccacgtattcggcgagtgcgatcaccccggaaaacaccaccagcgcggtcaccacgacccacaggttgcggacgcccgaccggatgtcgtctttgaagaacaggcccagaatgcagatcgggattgtgccgatgatgacataccagcccagccgataatcggtgtttcgatgtgccttcacgaccaggccgtgcaaccaagcgctcaggatgcgcacaatatcgcgcgcaaagtagatcactacggcggcctcggtgcccaactggctcacggcggtgaacgaggcaccggcgtcgccgctgaagaagatccgcgacacgatcgccagatgtcccgaggacgacaccggcaggaactcggtcaaaccctgggccgcggccaacacgatgacttgccaccaagacatcgccggagccgcggtcacgacgacgacggtacccggttaccggcggccggtagacggatgcgcctaacgcgacaccggcgccgcggatgccaccgagtcgcgcacggccgcagcaaggctgcgttcgtcggtcaggtcaatgtcgaccaggccacggaccgccatcgcgaccacatcctcagcctgcggcaccggaccggccacgcgcggtcgatagatttcgacgacgagcgagcgatgctcgatgtggaaggagaaactgcgtccatcgccgacttgcccatacccgctggcgaaaattcccgtcgatatatcttcaacagcaaactcttcgcgcttgtctgcgagatgccggtcagcggtgacggtcatgcccagagaatacctctggagtaccatttcccgtgggcgacatgacgagattgaaagcaacttgccagattcggattcgtgagaggttgacttcatgtttcgcatccgaaggctgaccgttgctaacagggaataaaccagcagttcaacgccgcttcatcggcctgttgatgttgtcagtcctggtcgcaggctgttcttcgaacccgctggctaacttcgcacccgggtatccgcccaccatcgaacccgcccaaccggcggtgtcaccgcctacttcgcaagacccggccggtgcagtgcgaccactgagcggccacccccgggcggcactattcgacaacggcacccgccaattggtggctctgcgcccgggcgccgattcggcggcacccgccagcatcatggtcttcgatgacgtgcacgttgcaccgcgcgtcatttttctgccgggcccggcagccgcgttgaccagcgacgaccacggcacggccttccttgccgcccgcggcggctacttcgtggccgacctgtcctccggtcacaccgcacgagtgaatgtcgctgacgcagcgcacaccgatttcaccgcgatcgcccgccgctccgacggcaagctggtgctgggcagcgcagatggcgccgtctacacgcttgccaagaaccccgcagttgacccggcgtccggcgccgccaccgtagccagccggaccaagatcttcgcgcgcgtggatgcccttgtaacacaagggaatacaaccgttgttctggatcgtggccagacctcggtgaccacgatcggcgccgacggtcatgcccagcaggcactgcgcgccggccaaggtgcgacgaccatggccgccgatccgctgggccgggtgctgatcgccgacacccgtggtggccaactactggtgtacggcgtcgacccgctgatcttgcgccaggcctacccggtgcggcaggctccgtacgggctggccggatcccgcgaattggcgtgggtgtcccaaaccgcgtccaacaccgtcattggttacgatctgaccaccggaatacccgtagagaaggtgcgttacccaaccgtgcaacaacccaactcgttggccttcgacgaaacgtcggacaccttgtacgtggtgtcgggatccggtgccggggtccaggtcatcgaacacgcggcgggcacccgatgagcagccgacccgcggcgcggcggacctggttgcctaccggctgggattccgagatgtccgacgagtacgagtgggcgccattgcgcctaccgccagaagtgaccagggtcagcgcgtccacccggctgtccatcgaggccgaataccgcggctgggagctagcacgggtacgcctctataccgacggcagcaggcgggtattgttgcgccgcaagaaatctcgctgggcagacgcagaggcgaaccgccggccagaccagccgcagctgtggctctgaaggccggggccagcccgcgcgcagaccgctatcggatgtatcccctggtgcgtcggctgttgttcctgatcccacccgagcacgcgcacaagttggttttcgccgtgctgcgcggcgtggccgccgtggcgccagtgcgccggctcttgcgccgactgctgggcccgacggatccggtgctggccagcacggtgttcggggtgcgcttcccggcaccgctcgggctggccgcggggttcgacaaggacggcaccgcactatccagttggggtgcgatggggttcggctacgccgagatcggcaccgtcaccgctcatccgcagcccggcaacccggccccccgcctgttccggctggccgacgaccgcgccctgctgaaccggatggggttcaacaatcacggtgcccgggcactggcgatccgactcgcgcggcaccgacccgagatcccgatcggggtgaatatcggcaagaccaagaaaacgccggccggcgacgcggtcaacgactaccgggccagcgcccggatggtcggcccgctggcgtcgtatctggtggtcaacgtcagctctccgaacacaccggggttacgcgatctgcaggcggtcgaatcgctgcggcccatcctgtctgccgtccgcgccgagacttcgacgccggtgctggtgaagatcgcgccggacttgtccgattccgacctcgacgacatcgcggacctggccgtcgagctagacctggccggcatcgtggcaaccaacaccacggtgtcacgcgacggcctgaccacaccgggggtcgaccggttgggtcccggcggcatctcggggccaccgctggctcagcgcgcggtccaggtgctgcgtcggctctatgaccgggtcggtgatcgattggcgctgatcagcgtgggcgggatcgagacggccgacgacgcgtgggagcgcatcacagcgggcgcatcgctgctacagggctataccggcttcatctacggcggggaacggtgggccaaggacatccatgaaggcattgcccgcaggctgcatgacggcgggttcggctcgctgcacgaagcggtcggctcggcaagacgtcggcaacccagctaaagcgctaacgctgctcgtaggtgccgaagatgaccgctcgtgcaatcgcgtgctggaacaggttgaatcccagatatgcaggactcgcgtcctcggggaggtcgagcttttcgaccttcaccgcgtgtaccgcgacgtagtagcgatgcaccccatgaccgggaggcggcgccgcacccacataccggcgcataccggcgtcgttgaccaatgtcagtgccccgcccggcagttcgcggccatcgccgacaccctcgggcaactcggtgacgttggcaggcaggttggccaccgcccagtgccagaacccggacagggtgggggcatcagggtcgtagacggttaccgcgaagctgcgggtctcgctgggaaatcccgaccacctcagctgcggactggcatccgccccgcccgcacccatgatcccgctgacctggggtgtagccagcggctgcccatcggtgatcgaggttgacgtcaggctgaaggacggcagcttgggcagcgcggcatacgggtcgggtgaagttgtcatggtcagtcctctcgtgtgatcgacgttgcgactagcctcgttttcgactagcagtgtgtcagcaagtgcgttagcacctcggtgccgaaccgcaacccatcgatgggtacccgctcgtcgacgccgtggaacaacgaggtgaaatccaagtccggcggcaagcgcagcgggctgaagccaaagcaccgaatacccaagcgcgcgaacgccttcgcgtccgttccaccggacagcatgtacggcaccgtgcgaccgtctgggtcgaccgccaacaccgcggcgttcatggcggcgaccagatcaccgtcgaaggtggtctcatatgatggcagatcgctgacccactcccgggtcacgtcgggtccgatcagcgcgtcgacttcggcctcgaacgccgcccggcgacccggaagcacgcggcagtccacaactgcctccgcggtcgccgggacgacgttggccttgtatccggccttgagcatcgtagggttcgcggtgtcatgtagcactgccttcaacatgcgggccatcgggccaagcttgtcgatcgtcccggccaggtccggcgagtcaaggtcgaaggccagtccggtctcctctccgactacggccaagaactgggcgacggtgtcagtgcagaccagcggaaactggtggcgccctaggcgagcgaccgcctcacaaacggcggtgaccgcgttctggtcgtgcaccatcgagccgtgcccagcccggccgcgtgccgtcagccgcatccactggatgcccttctcggcggtttcaatcaggtacaggcgacgttcgccaccatcgtgccggggcacggttagcgagaaaccgccgacttcaccgattgcctcggtgatgccgtcgaacagatcgggcctattgtcgaccagccagtgcgacccgtacttgccgccgtgctcctcgtcggcaacgaacgcgaacaccagatcccgtggcggcacgatagcggcctgacgaaggtggcgggcaaccacaatcatcatgcccaccatgtccttcatgtcgaccgcgccacgaccccagacgtagccgtcttcgatggcgccggaaaacgggtgcacactccattcggccggttcagccggcaccacatcgagatgcccgtggatcagcagcgcgccgcgagaactatcggcgcccgccagccgggcgaacacgttgccgcggccgggcgcaccggattcaacgtattcaggttggtagccgacttcggcgagctgctcggcgacccagcgtgcgcactcggcctcacccttggtggtcccgggttcgccactgttggtggtatcgaaccggattagcctgctgacgacctgggcgacatcatcgctgtggtcgcttgaagccccggtctcatctgtcacagtcacctttcctaccactcgtaaccctggcgagccgatcgcccctggcgcgccgggcccgcgtcgtcgccgagctggatttgcttacgtgggctgattgcctggctcctcctcaccccgttacccggggcgcatcgtcgccgagctcgatttgattgcccggctcctcctcaccccgttacccggggcgcatcgtcgccgagctaggttgggccggtgcggggcaatccgatagccttagctgccagccccggtggttggttggtccgagtggcggaatggcagacgcgctagcttgaggtgctagtgccctactaatgggcgtgggggttcaagtcccccctcggacacaacttcttagctctatagatcaaaaccaagccttgacctcgtcaaggactaacgttatgagtttgctcataccaacgatggtcatctcgttgatgtcctaatacctaagaactcaccgatcactcgaaggtgcggccagagatctcagcctcgaccgcgttcgggttctccattccgtgccgaacagccagtatgtcgatagcctcgtcggtcgtccgataggcaacgtagtacctgaagggccggaggtagatgtgtcgatagtgcttgaataacggcgcaaacgcgttcggagcctgcggaatccgcttcgtcacggcatcgacaaacaagttgtaaagccgatcgatctgatctggcgccgcgtccgcgtagtaggaaaacgcctcgaataggtcgtcttcaaccccgttatggacgcgcagcctgcgcgtcatccgagccgggcgcggatccgcttgtcgaagtcatcaatggtggaccaatgagcatcgtcggtgtcattggcccgcgcttcgatgagcgcctggttggcctcgctgatatgcatgccctcggctaggtttccgttgatgtgctcgacgagctcaatctgctcatcacgcgacagtgcgtcgacgctcgccagcaatgcccggttgaccaccactcaacgatacccaaggcagccaacgccggcagcgcagcattcggaggccaggctgaacttcaagctggcaggtgtcatccgctcagttgaaagacctcaacccgggtcgcaggtggccaagtcccccctcggacaccacatgtgacgggtcgaagacgaggcacgccgcggacgacttcgagggtaagcagccgtatcccggggaggcctgccatgaccacttctgggcctatggcagctagcaaacgtcatgaatggaagcgccaccatatgccggcgatccgacgttcgagcgtttgcggcgctcgtttcagccagccgatctactgccggaactgcaagcggcaggagtgcattacacaatcgctgtcgaggcggcggacgatccggccgagaatgagtctctgttggccactgcgcgccaccatgattggatagcgcgcgtgatcggttgggtcccactcgccgatccggatgaggttaccgagagctcgacgcacgggcggcaccgcccggacgcctcctggcgacgagatctgcggtgccccggcctgctgccgcccgggtgccaccagccagtcttggtcgtaggcttggtaggtcagcagccggaaatgcgaccgatgaatccaccaagtggttttctccggcggacgccgacccgcaggtttcgcgaccgccgcgatgctggtcgcgtattggccgacgaacttgcgtcctatcgcggcagggaccggttgctcgtcctcggccttgcccgcggtggcgtccccgtcggctgggaagtcgcgtcggcgctaggcgccgaattggatgtatttctggttcgcaagctcggcgtgccgcagtggcgcgagctggcgatgggcgcgttggccagtgggggcggggtcgtgatgaacgacgacgtggtttccagcttgcgcatcaccgaccagcaggtgcgtgcggcgatcgacagcgagacggcagagctgcagcggcgcgagctggcgtatcgcggcggacgccctgtcgtcgatccgcgcgccaggatcgtgatcctggttgacgacggcatcgccaccggcgcgagcatgctggcggcggtgcgcaccatccgtgccaccggaccggagtcgatcgtcgtcgcggtcccggtcggtccggccacagcctgccgcgagctcgcggcggaagccgacgacgtggtgtgcgcaaccatgccggcagcgtttgaggccgtcggccaggtctataacgactttcatcaggtcaccgacgacgaggtccgcgagctgctcgcgacgccaaccacaggcgcagcgacctaacgagaggattctcgtgaggtgactgggatggtcaggatgcgtggtcgagggtctagatccggagctgggcgacaaaccacccgataacctcccacgacgcccctaccgaggtcggtgtcgctgacgaccctacttggcgctgtcgtcgcttcggtccgccgataccgccgactcctcggtcgcttcgctggcctcctccgatggctcctcactgccgatgacaccggcgtcgacggcttggctctcctcgggggcttcctccgggtagtcgacgtcggcttcctccgcgacacccgtttccccagccccatcagcttcgtccgcgccaccttgctggcgttctcgcaacgcatcgacgatcagcaacgccacacccagcacgctggccccgatgcatacccaggccactagctggttgctggtgaccaccgcgaacaccaaggccaggagcccaatcagggccaagaccagcgcaatgatcagcatcggtcatcctccaaccggctagcagcgactgcccaacctaccaggatctggctgccgacctcgaaaactggcgcgtgtccggcacgcctggtggctagtttttgccccggttgaattgatcgaagccaccggcatccgcattggaatcgaccggcgccgccgatccacgctggccgagttcctccagctgcgattccaggtaggtcttgagcctggtgcggtactcacgttcgaaggtacgcagctgctcgaggcggccttcaagcaccgcgcgctgctggttgatggttcccatgatctcggagtgcttgcgttccgcatcggcctgtaaggcatcggccttctcctgcgcctggcgcaactgggcctcggatcgggattgggcatcggccagcatggcatcggcacgctggcgggcctcggcgaccgtggcgtcggcggtgtgtcgggcctcaccgaggatctgctccgcattggcacgggcatcggccagcatcttgtccgactcggctttggcggtgtttgtaagccggtcggcggtgtcttgggccagactcagcactcgcgccgccttcagggcctgttcctcgttcatccccgccgagaccgccgccggcgccggcttgcccggttcgggctcatacgccgggattgcctgggtggcctgcggcgtaacgccggcaccgccgcccgcggcgagctcttgatccagctcgttgatcctctgacgcagatcggagttctcttcgatcaggcgggtcagctcgttttccaccaggtcgaggaaggcgtcgacctcatcttcgttgtacccacgtttgccgataggcggcttactgaacgccacattgtggacgtcggcaggtgtaagcggcattgtttgtcccctcgagttcctggacggtcaaacgatctggaagtgtagaacggagtggtagccgtggtgcaactaccgtccatcctgtcacaccagactcggcggttgccgattggactaagtaaataaggaccaatttcaaactctaagaccaaataaatcacaatccttagatttgaaatcgtgcgcgccaaacttgtccccaaatcgtggccgaaccgtctctcaatcctcgtcatgcacccggccgtgtgaccgcgccgcggctcaggccgcagcaccaaacgccagttgcataccgatgaacgcaaccagcagcagcaccatgatcgacaggtcgaaccggaccgcgccgatcgtgagttgcgggatcagccggcgcagcaccttcaccggcggatcagtgatcgacatgatgatctccaagatcaccacggtgacaccggtgggacgccagtcacggctgaacgagcggatgaactcaacgacgacccgagcgatcagcagcagccagaagatgaacagcgcgaacccaaggatctgaaaaaacaccaccaacgagagccccgaccttactgaggaggatgaagaaatgttgcgtcgccaccgatgcgggcggcaacgccagcctaccgactcgggtggcgtgcccacatctcatggcgggccacgccccgcccagcgtggatgcccaatgggtctacaggcgaccgtcgcgtctattggtaggcgtagaacccggtttcggcgatcctgcggcgctcctcgggggacacatcgacgtctgcaggcgagagcaggaacaccttggtcgcgaccttgtcgaacgagccgcgcagcgcgaaggccaggccggccgcgaaatcgaccagccgcttggcatcggcgttgtccatcgacaccagatccatgatgaccgggctgccgtcgcggaaccgctcaccgatggtgcgagcctcgctgtagtccttgggccgcagcgtggtgatcttcgagagcggatggccatcctcgaacatcatcgccatccggcgggggtccatcgctagcgcgccgcgggtggagttgcgcagccacgatccgaagcgcggccgtgtcatctccgcgcggtcgaactcccggggccggaaacgtggttcgtccgcgtacccgccgcgatatcccggtggtggatagtcggccggctcaccgcgcaggtcaccgcgtgaatcgctgcgcgcgtcgtcgtagtcgcgcccatcgtagcggccgtagtcgtcgtcgaatcggggccgcgcatacccgcgcgagggagcgcggtcgtcgtagtactcgtcgtcgtaatcctccatgggagccataccgaagtaggccttgaccttgtgcagtgtgctcattgcgtgaccccttctagccctgggagatctgttgtctgtgatgaaggtgtgactacagtgactattcacggtgaccgtaaccgccgcggacccaatagcgcggtaccgacacgcacacaggtcgaaccatgtttgacggcgacttcaaggtcgttggacatgcccgccgacagaccgatcgcgtgcgggaacatcgcacgcacccggttgtgctccgattgcagccggtcaaaggcctcgtccgggtcccaatccagcggcggaatgcccatcaacccgaccagttcgaggccctctgactcctgcacctgcgcgcaaatccggtctacggcgccgggcgtcgtgctgtcgacgccgccccgggatccgtcaccgtcgaggctgacctggacgtaaacccgcagccgctcgccacgacggtgttcggccagcgccgcaacaaccgcccgatccagcgcggtcaccaaccgcgagctgtccaccgagtgagcggtgtgcgcccagcgagccagcgacccggctttgttgcgttgaatccggcccaccatgtgccagtgcacaccccccgagtgacccaactcggcagccgccaacaaccgattaagttcggccatcttggctgaagcttcctgttcgcgcgattcgccaacggaccgacaacccaatcgaaacaaaatcgcaacatcggttgctggaaagaatttggtaatcggtagaagttcaatttcgccgacattgcgacccgccgcctccgcggccgccgcaagtcgcgatcgcattgccgccaacgcatgcgtcaattccgattcgcggtctggatacgccgaaagatccgccgccatcgcggtcattccatccacaccaacgacgcgaaccgtccggtgggcgcatcgcggcggtggctgaacaacgtcggatcggccaccgtgcagcggggatcgacgtcgatagactcaacacccaaatcgcggagctggcaagcgattccggcgcgcaggtcgactccgggagtgccggcagcggtggtggtgcggctgcccggcaacgccgcctcgacctcatcggccatcgctgcgggcacttcgtagttgcgaccactgaccgcgggacccaacagtgccgagatgtcgcggacctgggcacccaggctcaacatcacctccagcgcgcgaaccaccacaccgcgctgcgcgcctgcccgaccggcatgaaccgcggcggcgataccggcccgtgcgtcggccatcagcaccggcacgcagtcggcggtcacaaccgccagcgccaatcggggtgtagcggtcaccaatccgtcggtgtcatcgagtgccgtattgcgcggctggtcgaccagctcgacccgatccccgtgcacctggttcatccacaccactcggttgccgggcagtccgatggctgcggccagccgagcgcggtttgccgccaccgcggccgggtcgtcaccaacgtggtcgccgaggttgaaggtgtcgaacggtggggccgacacaccacctgcccgggtggtggtgacccgacggatgcgaacactcacgttcccagtatcgccgcgggcgatgtgccgcgtactggcgagcaagccgatgctctcagcggcgcatgaagggcggcacgtcgacatcgtcgtcatcaccgccgatgctcagggttgcgccgttggtgtgcaacggcacgctgacggcgtcgaccggctcgaacaaggtcgaggtgagcttgcctgccttggctgactcgatccggtgggcgccgccggtctcgcccatcaccggcttgcggccgggaccgctgacgtcgaagccggccgcgatcacggtcacccgcacctcgtcaccgagcgaatcgtcgatgacggtgccgaagatgatgttggcatcggggtgagcggcgtcttgtaccaacgaggccgcctcgttgatctcgaacaagcccaagtcgctgccgccggcgatcgacatcagcacgccttgcgcgccctccatcgaggcttccagcaacggcgagttgatggcgatctcggccgctttgagcgaccggccttcgccccgggccgagccgatgcccatcagtgcggtgccggcaccggacatgatgcccttgacgtcggcgaagtcgacgttgattagacccggggtggtaatcaggtcggtgatgccctgcacgccgttgagcagcacctcgtcggcgctacggaaagcatccatcagcgataccgcggcatctcccatctgcagcaaccggtcgttgggaatcacgatgagggtgtcgcaactctcccgcagcgccgcgatgccattttcggcctgattgctgcgtcgcttgccctcgaacgagaacggccgggtgaccacaccgacggtcaacgcgcccagcttgcgggcgatgctggcgacgacgggtgcccccccggtgccggttccgcccccctcgccggcggtgacaaacaccatgtcggcaccgcgcagcagctcttcgatctcgtccttggcgtcctcggcggccttacggccgacctccggatcggcgccggcgcccagcccgcgggtggagtcgcggccgacgtcgagtttgacgtcggcatcgctcatcaacaacgcctgggcgtcggtgttgatcgcgatgaattccacgcctttgaggccctgctcgatcattcggttgacggcgttgacaccgccaccaccgatacccacgaccttgatgacggccaggtagttgtgcgggggggtcatcgttcggcttcctccctggtggggctcggttcttcggtgtgtctgctggcaaactctcaacctcaaccataggcttagagttatgtcaagtagttgctcgtagtcagaaccgtatggctacgacggttgctaaccgtgcaggcgcgccgatacgcggcgggcattttttcggctatttcacggtcggcaggtcggggctggacacgtcgtacgttctgcctggctgggtcaacagcgccgccagcttttcggccttctcttcgcagcggtcggtggttccccagatcaccacgcggccatcggccaacgtcagggtgatcgaggccaccgacggggccgcgatccgccccacctggcttgcaacttcaggatgcagcgcggtcaacacctgcagcgccgccttggtcgtcggatcgctaggaccgggattgtccacatcgaaataaggcaacgccggcggtggcggatcggtcgcgaagtcgacgccgtcgcggtcaaaaaggtgcgggccgtccgaaaaatccttgaccaccaccgggacccgctcgacgatggtgatccgcaaggccgacgggtactgccgctgcacccgcgcactggccacccgccggatcgtggccactcggtcagcaacctgttgggtgtcgatctgcagcaacggcgttgccggccgcactctggcggcgtcgagaacctcctcgcggctcaccgccccgatcccgatgatcacgatctcgcgggccgacatcgccggcgtgaagtacagcgcgagcccaagcccgatcccgacgacggccagcacgaccgtcgcgagcagcgccttcagccctcgaacaacacctcgggcggccggtttggcggggttctgctcactgacgatctgcccgcgggctcgccgtttggccgcgcggcgagcctgctcgatcgcggtagctcgagcctgcgcggcgcgacgttcggcacgttcgcggcgggcgcgccgacgcggcccttcgaattctgggtgctcggccggttcgtccttcgattcggtggccaacggctccgtaaccgcctcctcgtcggcggcgtcgtcggccacgcgctcgatctgtgggtcctcgttgtgttccgtcatcccagcacccccggacggccgggggcgcttcggttggcccggacccgaagggcggtcaggatttccgggcccagcaaggtcacgtctccggcacccatcgtgacgatgacgtcgcccggactagcggcggcggccacttgctgtgcgaccgccgaaaaatccgggacgtagcgcatcggcacagtgacgtgctcagcgacgctggctccgctgacaccggccagcggttgttcacgagctccgtagacgtcgagtacgaacacctcgtcagcggcattcagcgcacgcccaaactcagcagcgaatgcctttgtccgcgaatacaaatggggttgaaacacaaccatgcagcggccaccgtcgccctgttcgagcaccatgcgcgccgccgccagtgtcgcgctgatctccgtcgggtggtgggcgtagtcatcgaacacgcgcaccgacgcctttccgacgccgcaggtcccaaccagttcgaatcgtcgccgcactccttcgaagccggccagcccgtcgagcacctcgtcggccggggcgccgatctgcaccgcggccagcagcgctcccagcgcgttgagcgccatgtgtcgcccgggcaccgacagccgcatcacgcggggaccctgtgctgtggctagttctgaggccaaccggatatgtgcgaccgcgccgaccccctgttgctgccacgagaccaacgtggctgccatggtctcacccggcaccgacccgtatcgcagcactcgaattcccagctcagtcgcgcgctgagccagcgcggcccctccggggtcgtcagtgcacaccaccagcgcacccccggggacaatgcgctccacgaaggagtcgaacaccgcaacatacgcctcgacgctgccgtagaagtccaggtgatcggactcgatgttggtgatcaccgcgacgtggggtgtgtactgcaacagcgagccatcgctttcgtcggcttcggcgacgaaacagtcgccactgccgtgatgggcgttggtaccggcctcccccagctcaccgccgaccgcaaaggacgggtcaagcccgcagtgctgcagggcgacgatcagcatggacgtcgtcgttgtcttgccgtgcgtgccggtgaccatcaatgtggtgcgcccggccatcaacttggccagcacggccggccgcagcaccacgggaatgccgcggcgcctcgcttcgacgagctcggggttggttttggggatggcggcatgggtagtgacgaccgccgtggcgccaccgggcaacaggtccagcgacgacgcgtcgtgtccgatccggatcaacgcgccccgcgcccgcagcgcatgcacaccgcgcgactccttggcgtctgacccggagaccagcccgccgcggtccagcaggattcgggcgatgcccgacatgccagctccgccgatgccgaccatgtgcacccgccgcagatcgggcggcaactgctcggtgctcacgtcgttgtcctggcaccggccccggtggcgacggccagcgcggcccgggccacctggcccgcggcatcgcgatgtcccaccctggctgcggccgcggtcatcgcggccagccgcgcggggtcggtgagcagcccggcaacctggcgggccaccaactcgggggtcagggcggcgtcggcgaccaccatgccgccgccggcattgactaccggcaacgcattcagccgctgttcaccgttgccgatcggcagcggcacgtagatggccggcagaccgacggcggatacttcggcgaccgtcatcgccccggcccggcagatcaccagatcggcggcggcgtaggccagctccatccggtccaaatagggcaccgccacgtacggtgggtcaccttgagcccgacggcgcaactccagcacgttctggggtccatgggcatgcagcacgcaaacaccggcggcggccaggtcggcggcggcgccggacaccgcccggttgagcgagaccgcgccctgcgaacccccgaacaccagcagcacccgcgcgtcgtcggggaagccgaagtgtgcccgcgcctcggctcgcagcaccgcgcggtccagcgcggcgatcgacgcacggaccgggaccccaaccacctcggcgcgccgcagcccggaatccggcaccgcggagagcacccggtccgcggtatgggcgccgacccggttggccagtcccgccctggcgttggcttcgtggatcaccaccgggatccggcgccggcgccggggcggcaaaggcaggccgcgagcggctaggtaagccggtagcgcgacgtacccaccgaaaccgacgacgacgtcggcgtcgacatcgtcgagcacgtcccgggcctcccggacggcgcgccacacccgcgacggcagccgggccaggtcgccgccgggcttgcgcggcatcggcaccgccgtgatcagctccaggtggtagccgcgctggggcaccagcctggtctctagtccacggagggtgcccaacgcggtaatccggacgcgcggatccaacgcgaccaaggcgtcggcgacggccatggcgggctcgacgtgcccggcggtcccgccgccggcgagaacgaccgacacggaatcagcagacggcgaggaaccacaagacggcgaggcggcatcggcgggccggggcgccgttgccccgcgcccgccggccggctggctgaccgtgtccttcacccgtaacgctgaccttccaatgcccgaacgcgccgtgtgcgacgctggcccgcgtaccgctggccagctccatgatgcactgatcgacgaaccggcggatcggccgtgcggggcgagccgggtcgcgggggcaggcccatctgccgggcaggctgtccgggcgccgtgcggggggtcttccgcgcgggctgcgtttgggccggttgcgggttggcgcgcttgcggtcacgaaacgcctcgagacgagggggcagatacggctcgggcagcggcagccgcagcaaccggttcaccttgtcgtcgcgcccagcccgcagcgcggccaccgcctccggttcgtggcgagccgcgttggcgatgatgcctatcagcgaaagtgttgcggccgtggaggttccaccggcggagatgagcggcagctgcaggccggtgacgggcagcagcccgatcacatagccgatgttgatgaacgcctgtcccagcacccacagtgtcgtggtggcggtcagcagccgcaggaacgggtcggcggaccggctagcgatgcgcatgccggtgtaggcgaacaatccgaatagccccagcagtccgagcgcgccgacgagacccagctcttcgccgatgatggcgaaaatgaagtcgttgtgggcgttgggcaagtagttccacttggccacgccttggcccagaccgtcgccgaaaatgccaccttgagccagcgcgaactttgcctgtcgggcctggtagccggagtcttgcggatcgttttcggggttgagccacgaccgcacccggtcggatcggtagcccgcggacaccgccaggatggcggccgagacgacgaccgccgccagtgagctgaggaagacgcgcagcggcagccccgcataccacagcaggcccaacaagatgatgcccatcgacacggtctgtccgaggtcgggctgggccacgatcagcgccagcgcaacgacggcggccggcaccagtggaatcagcatctcgcgcagtgaagcccgttccatgcgccgggcggccagcagatgcgctccccagatggcgaacgccatcttagccagctcagagggctgcatcgagaagcccgcgaccacgaaccagccgcgcgagccgttggcctccttgccgatccccggcaccagcaccagcaccagcatcacgatggtgatcgcgaaaccggagaaggcgatgcgccgcatgaaccgcaccgacatccgcagacagacatagccgccgataagacccacaagcgtccacaagacctgcttgccgaagatcacccaagccgatccgtcgtcgtcgtaggaccgcaccgccgatgccgacagcaccatgatcagtccaagggtggtcagcaatgcggcaacggcgatgatgaggtgaaacgaggtcatcggacggcccagccaggcaccgaaacgggtgcggggcctcgccgaacccgggttagaggcttcttccgggcccgtccgctgcccctcgaccggctcggcccctcgagtctgggagccgtcggtgtcgctggtgccccgacgcagcaaccgggttagcacgctgcccccgcctaccggatcaccgcgcggaccgcggtcgcgaatgcctcgccccggtcggcataaccggtgaactggtcgaatgaggcgccggccggtgccagcagcacggtgtcaccgggttgggccatccgccgggccgcggccaccgcagcggtcatcacggcagcgccaacggtctcaccggctttgtcatcttttgccacatctagaacacaagcaacaggaacctcaacagtcgcaggcataccagtatcctcgcctgccacaacctgaacgactgggacatcgggcgcgtgtcgtgataacgcctcggcaaccgctgcgcgatcccggccgatcagcaccgcaccgaccagccgcgacgccatcgccgcaacctcggcgtgaagcgacgcgcccttgagcaggccaccggcgatccataccaccctcgggtatgcaagcaccgaagcccgcgcggcgtgcgggttggtggccttggagtcgtccacgtaggtgatgccgtcggcaacggccaccacctcggcgcggtgtcggcccactcgaaacgacgtgaccgcgtcggcgatcgcaccggcgggcaccccgaccgagcgggccagcgccgccgcggccagggcgtcaagcacgccgaccggacctggcaccggtatcgacgcgaccggcagcagcgtcaagtcgtcggagaaggcgcgatcgaccaggtgggcgtcgcgcacgcccagttcccgcgcggccggctcgccgagccggaagccgacccgcacctgcgccggtgagccgtccagcagtgcggccgctcggctgtcatccagcccggccaccgctaccccgccggtcagcacccgggccttggccgcggtgtattcggccatcgtggcatgccagtccaggtggtcttcggcaatgttgagcaccgcgccggcctcgggccgcagcgacggcgcccagtgcagctggaaactggacaactccacggccagcagctcggccggctcgtccagcacatccagcaccgcactgccgatattgccgcacagcacggcgcggcggccaccggcgatcagcatggcgtgcagcatcgacgtcgtggtggtcttgccgttggtgccggtcaccaccagccagctgcgcggcggtccgtagcagcccgctgcgtctagccgccaggctaactccacgtcaccccagatcggcacccccgccgccgcggccgcggccagtagcggggttgcgggcgagaagccgggactggcgaccaccagcgcatacccggttatctgctgcaccgcgtccgaggaactaacggtcggcagcccacgttcggcgtgcggtcgcagcatgaccggatcgtcgtcgcacaccgtcggcgtcgcaccaaaccgagtcagcaccgcggccaccgcctgaccggtcacccggccaccggctaccaacacgggcgcacccggccccagagggtcaagcacgtcaggcaccgaccgcggcaagccactcaccgtagaacaaggccacgcccagaccgcaggtgatcgcggtgagcagccagaaccggatgatgaccgtggtttcagcccaaccgaccaactcgaaatggtggtggaagggcgccatccgaaacatccggcgcccggtggtccggaaggtcaggatttgcaacaccaccgaggtgatctcggcgacgaacagcgcacccagcaccaccgcaaggatctcggtgcggctggtcaccgacaaccccgcgatgacgccgcccaacgccagcgacccagtgtcacccatgaagatcttggcgggcgcggcgttccaccacaaaaaaccgatgcaggcgccagcggttgcggccgcgatgagcgccaggtccagcgggtcgcgcacgttgtagcagcccaggcccggcgccgtcacgcacgcgttgcggtactgccagaaggtgatcagcacgtaggcggcggtgaccatcgccatggtgccggcggccagcccgtccaggccatcggtgaagttgaccgcgttcgaccaggcgctgacgatgaccacgcagaacaacacgaacagcaccggcgccaatgtgacggtggcgatctcacgcacgtaggacagatccgcgctgcccggtgtcaggccggcagcattccggaactgcagcaccagcacgccaaacagcacggcggaggtgatctgcccgacggtcttggccgtcttgttcaacccgagattgcgcgacctgcggatcttgatcagatcgtcgatgaacccgacgccgcccaaagcggtggctaggcccagcaccaacagacccgatgcgccgatgccttcaccgtcaaacgccaggcccgctaggtgggcgcccaggtagcccgcccagatgccggccagaatcgccaccccgcccatcgacggcgtaccgcgcttggtgtggtggctgggcgggccatcctcacggatctggtggccgaagccctgcttagtgaacaaccggatcagcaccggggtcagcaagatggacaccgtcaccgctacggcaacggcgataaggatctgcctcatgggcgcacactcccgcatgtgtcgtctgcgaccaatgcatcggccaccgcacccagcccggccgcgttcgaggccttgaccaagaccacatccccgggtcgcagctcggcgcgcagtagtgccagggcggcgtcaccgtcggccacattgacggccgtgcgatccgcaccgtgatcagcagtggcttcccccgagccccacgccccctccaggaccgctccgtggtgcatggcgctgatcgacctcccggttcccacgacaacgagtcgagacacatctaagcgcaccgcgagccggccgatgcgatcgtgctcggctatcgcgtcctcacccagctcggccatctcacccagcaccgcccagctgcggcgggtggcctcgggttggtgcgcgatccaggccagcgcctgcagcccggcccgcatggagtcggggttggcgttgtaggcgtcgtcgatcaccgtcaccccgtcgccgcgggtggtcacctgcatccgatgccgcgacaccggcggcgccgcggtcagcgcggccgcgacctgttcaacgctggccccacactccagcgcgaccgccgcggcgcacagcgcgttagtgacctggtggtcgccgcagaccccgagtcggacctcggcttgggcatcgtgggcatgcagcgtaaagcgcggcctggccaattcgtccagcgacaccggccccgcccaaacgtcaccggtgttgtcccggctgacccgcaccacccgggccgcggtcagcttggccatcgccgccaccgcggggtcatcagcgttgaggacgaccgctccggaatgcggaacagcctgcggcagttcggctttggtctgtgcgatgacctcgcgggagccgaactcacccaaatgtgcggtgccgacgttgagcacgactccgatcgacgggggcgcgatctcggcgagcgcggcgatgttgccgtgatggcgtgccgccatctccaaaatcaggtagtcggtgcgccgcgtcgcgcgcagcaccgtccacgggtgacccagctcgttgttgaacgatccgggcggggccaccacctcccccagcggggccagcacggcggccatcaggtccttggtcgacgtcttgcccgacgagccggtgatcccgatgatggtgagcccgccggccaccaactgcgcggccaccgcggtggccagcttggccagcgcggccagcaccgccgcccccgacccgtcgttgtcgtgctcgaggacgccggccaatacgttcggcgcggccactggcggaaccacgatggccggcacccccaccgggcgggcggccagcacgacggcggcgcccgcggctaccgccgacgcggcatggtcgtggccgtcggcgcgcgcccccggcagggcgaggaacagcccgcccgggccgatggcgcgcgagtcgaactcgacggtcccggtgacgcggcggtgcgcggcgtcttgcggggagatatcggccactgcgcccccgacgatctcggcgatctgcgcgacggtcagctcgatcatgcgcgccgctcgagggcctctagcgcggcagccagctccacccggtcgtcgaacgggcggacccgcccgccgccgcgttgcccggtctcgtggcctttgccggcgatgagcaccacgtcgccggggcgcgcccaggcaaccgcgtgccggatcgcgtcccgccggtctgcgatctcgacgacctgggcatcaccgccgacttcggccgccccagccaggatttcgcggcggatcgccgtgggatcttcgtcacgcgggttgtcgtcggtgacgaccaccaagtcggccagctgcgcggctatccggcccatcggggcccgcttgcccgggtcacgatcgccgccggcgccgaacaccaccgccagccggcggtccgggtgcgccaaggtggtcagcaccgaccgcagcgcttccggtttgtgcgcgtagtcgaccagcgcgagaaagccctggccgcggtcgatctgctcgagccgccccgggacccggatctcacgcaggcccggcaccgcctgttccggggagaccccgacggtgtccagaatcgccagggcgaccaggcaattggcgacgttgtagcggcccggtagccggattccgatgtgatgccctacgccggcggggtcgatggcggtgaattgttgcccgcccgcgtccgtgggcgccacatccgtggcgcgccagtgtgcgggccggtcggcggcgctgacggtgatcgcgtcggcggcccgcgccgccatcgcgcgcccggcgtcgtcgtcgatgcacaccacggcggtgcgggcgcgcagtgccgagtccggatcgaacaatgacgccttggcctcgaagtagtcggccatgctggggtggaaatccaggtggtcacgggagagattggtgaaggcgccgacggcgaaccgggtgccgtccacccggcccagcgccagcgcgtggctggacacctccatgaccacggtgtccaccccgcgttcgaccatcgccgccagcatcgcctgcagcgtgggggcctccggggtggtcagcgcgctgggaaggtcggcgccgccgacgcggatgccgatggtgccgatcagcccggcgacgcgtccggcagcccgtaacccggcctcgaccagataggtggtggtggtcttgccggacgttccggtgatcccgataaccgtcaaccgctcggacggatgcccgtacacggtggcggccaagccgccgagcacgccgcggggtgcggggtgcaccaacacgggcacggccgctcgtccggcgatctcggcgaccccggcggggtcggtgagcaccgcgacggcgccgcgtgcgatcgcgtcgccgacgtggcgggccccgtgggtggtcgagccggtcagggcggcgaacaggtcaccgggtgacacgtcctgggcgcgcagcgtgaccccggtgaccgtccggtcctcggtgacggcacgctgagctggaccctcggccagggccgcgccgacctgatcggccagtgcggccaaccgaacgcccacgacggcgttggggcgcaagccagtgggcgcagcctccacctgtgtcgccacctccgttcgccgccgcgagatccctcgggccagcgatgacaccctaccgacagggcgcgcacactcacccagtcgggttttgccgcgacacctggccctcggcggcggcgccgatccaggtgccgatgcgccgcgcggcggtgaaggcggcccaggccagggcgccaaccagcgccgcatcggtgtcgagcagggatcgggccgcggcgacgtcgtcgtcggtcacctgatgcggggccaggccggtcagcagggcaagacgggtgggcgcgtgcaggtcggcgggcagctcggcggtgtgctcgttcgtccagcgactgctcatcggcattggctcgccgtgccacgaccccacgacccgcctgaccacctgacgagtcggtggcggcaggtgcggcgcggtgtccaggtggtggctgagcgcggcgaacgcggttgctatgggctcggacggtgttgcccatgccagatcgtcgggcagcgttcgcggctcgagccggcgggtggagcggcccggccgatgctccgcgcgcaccttgcgggcgaacaccagtccaccggcgcggcgcatgagctgttgggcgcgcgggccccccggcaggaaggtttcgtccagcagcaccaggaccaggcgtgcgatgaagtggaattgcaccgcggtgcccaggtattcggcggcgacatccgggccgaacggtgccggcggtcccgccggtgtcccggttcctgccgcccacgccacatacggcgcgttcgggtcaccggcggcaggtgctgtgccggccaagatcgccgcggcggtgtcggtttggcctgccgcgtacagcatggtggtgtgtgcgtcgacgcaccaggggcagcgcaggctggccgcgacggcggcggcgacggcttccttgcggccacgcggcacctggcccaccagcagtgtctcgcgcaacgtcgcccagccggcggtgagcagtccctcgtccggggacagcatggcgagcggctcgggcagccggccgaactcgcggcgggcctcggcatagacctcggcgaccgcgccgccggctcggcggggcgcgacgggctcaatatggttgacaaatttcatgattcgactccctcctgggtggtgccgactctggccagggccgcgtcgatcgccgttcgcgcccgctctccggcgccgtcgtcgtcgagcagcagcagcgcccagttggcctccatcgcgtaggcgtgcagctcgaacgcgagttggcgcacttcgatatccgcccggatctcgccccggcgttgcgccgtttcgacgtcggccgtgatggcggcgattccggcccgcccggtcgcggcgatgcggtcgcgcaccgggccaggctgtgagtccacgtcggcggccgcggccgcgaaaaagcagccgccggcacgtcgcgttccaggtatccgacccacgcatgcatgagggcgcgcacccggtccaccccgggcggcgctgccatcgcgggagccacgacctcggcttcgaacacgctcacggcggcctcgacggtcgccagctgcagctgctccttggcgccgaaatgccggaacaggcccgacttgctcatgcccagccgcccggcaagctcgccgatggacagccccgagagccccttcaccgaggcgatatccatcgcggcgcgcaggatctgcgcccgggtttggcggccgacgtcggcgctaggcatggcttttgacctcccggtcgtctccggcgaacgcatccaccagcggggccgaccggtccagggcggccagcacctggtcgcggcccgccgagggcagcgcgagcgccacctccgcgacaccggcccggcggtactcgtgcagggtcgccgggtcgccggccgacgagtacacacagacctgggcggtcgccggatctcgcccggcacgctcgaacgcggcgtgcagcatcggcaacgcgcccaggagctcgccgtacccctcgatcggctgccaaccgtcgccgtggcgggcgatcacctcgaacgcccgcgcactgggccggcacccgaacagcaccggcggcgccacggccggtttcggccacgcccacgacggcggcaccgacgcgtgcgtgccctcgtagtggaccggctctgcggcccatagcgcccgcatggcggcgagcttgtccaccgtcaccgcgatccggtcggcgaacggcacgccgtggtcggcgagctcctccacgttccacccgaaacccacccccagcacgaaccgctcgccggacatggcgcacagcgaggcgatctgtttggccagcaggatcggatcatgcaccgccaccaggcaggccccggtgcccacgcgcagccgcgtcgtgaccgccgcggcggcggccagcgccaccaccgggtcatagcagcggcgataccagtccggcagctctccaccgggccacggcgtgctcctgctgatcggcacgtgcgtcttctccggcacatacaggcccgcgaagccgcgctcctcggcccacaccgcgaccaactgcgggggtggggtcaggtcggtgacgaactgcatgagcgagacgagcatcggcggcggctttcattaagcacgaacgttcgtgtttaacgatggtccgcctggggcgtgctgtcaatgccggattgcgtgaccgctcgctcggggcccgggtcagccgtcggcgccgtttgctccaggggtgccgaacagcacaccacggctgccgccggcaccaccacttccgacgggtatgccgaagccgccggccccgccgttgccgccgttgccgatcaccacggcgttgccgccgttgcccccgttaccaccgtcgcctttaacgcctggggggccgtcgccgccttccccgccgttgccgccgcgcccgccgtcaccgatcagcctggcgttgccgccggcgccgccgtcaccggcattacccggcgtgggagcctgtccgccgttgccgccgtccccgccgccgccgccgctgccgatcagcccgccgatcccgccggcaccgccgatgccgccgtccccgccgctggtgccggccgacgagaagccgccgttgccgccgcgcccgccgacgccgccgttgccgtagaacagcccgccgttgccgccggccgcgccggcgccgccggaccccgcatcggcaagggtggagctgttgtcgttgcccccgttgccgccggcaccgccgttgccgccgttgccgatcagcccgacgtgcccaccggccccaccggccccaccggccccaccggcgccgccggccccaccgctgttgccgtggccaccgttgccgccgtgccccccgtcgccgccattaccgatcagggcggccccgccggcaccacccgccccaccgctggcgccggtgttgctgagcccgccgttaccgccgtcaccgccggcgccaccgttgccgatcagcccggcggcgccgccggcaccgccgtttccgccgtgcaccccggtcaccccgttgcttccgttcccaccagccccgccggccccgccgtcgccgtacagcagcccgccgcgccctccgtcaccaccggcgccgccggcccccggtgccccggatgcgctgccgccggccccgccggccccgccatggccccacagcccggcggccccgccggccccgccggcggggctgacgcccccggcggtgccgagcccggccgcacccccgggccccccgttgccgtacagccatccgccattgccgcccgcacctcccgctccggtggccgcacccgcgcctccggccccgccgttgccgatcagccccgccgatccgccgttgccgccgttgggattggcggtgtcaccggccccgccgttaccaccgttgccgtacaacaagccgccgggcccaccgttttgcccgggacccccgtcggcgccgttgccgatcaacgggcgccccagcaacgtttgggtgggcgcgttgatcgcgttgagcagggtctgctgcacgttggcggcctcggcgctggcatacgagcccgcgccggcgttcagggcccgcacgaactggttgtgatacgccgccagctgagcgctcaacgtctgatagccctgggcgtgcgacccgaacaacgccgagatcgccaccgacacctcgtcggcgccggccgccaggattcccatcgtggggcctgccgccgccgcactggcggcgctgatcgacgacccgatgttcgccaaatccgtggcggccgctgccatcacctccggcgccgcaatcacaaacgacatcccgcacctccgaccagctcagcacaacttcacgaatcccagacctgcgacaccgtcggcagggctttcgatcctataacaatctgaaaacaggatgtcgcactttccttaaaagagcttccgccaacccgatcgtcagcgcgcacatgttgcgcaaaagttgttggagccgaaacgaaccggcgcgcgccgttaccggcgccgccgccctaggtggcctgcaagaccaaaggaggcccgggatcgggtgacagcgggacgttttcgcgctgcatcagccagcccgcgatgttgtggaacagcggggcggccgagtgcccaggcgcgccgtcggagttgcgcgccgggttgtccaacatgatgccgatcacgtagcggggattgtcggcagtggcgattccggcgaaggtgatccaatacacgtcgtcgaagtagcagccgcagccagggttgatctgctgcgcggtaccggtcttgccggccatctgatagccgggcaccccggccgtcggcccggtaccctgctggtagcccatcggatcgcgttgcaccacggcacgcagcatctggcgcacggtctgggcggtctgcgccgacaccacgcgaatgtcgtcggggcgcggttcttcggttcggctgccgtcgggtgcgacggtggccttgataatgcgtgggggtacccgcactccatcgttggcgatggcctggtacatgccggtcatctgcagcaaagtcatcgaaagaccttggccaataggaagattagcgaacgtactgcccgaccactggtcgattggcggcaccagtccggcgctctcaccgggcaggcccacgccggtgcgctgtcccaacccgaacttgcggagcatatcgtaatagcgttccggtccgacacgttgggaaagcatcagcgtgccgacgttggaggactttccgaacacccccgtggtggtatagggcatcacgccgtgctcccaagcgtcatgcacggtaacaccgcccatctggatcgagccaggcacctgtagcacctcgtcggggctgctcaacccgtgctcgatgaccgcggacgcggcgacgatcttgttcaccgagcccggctcgaagggcgacgacaccgccgggttgcccaactgcttgtcgccctggcgcccgatgtcttgcgacgggtcgaaggtgttgtcgttggccatcgcgagcacctcgccggtcttggcgtccaggacgacggccgagacgttgtgagcccccgataggttcttggcctgctgcacctgctgctgcacgtagaactggatgtcgttgtcgagggtgagcacgacggtggaaccgtggaccgccttgtgccgattccggtagctgccggggatgacgacgccgtctgacccacggtcgtaggtgaccgatccgtcggttccggccagcaccgcatccagggagtcctccagacccagcagcccatgaccatcccagtcgatgccaccgacgacgtttgccgccagcgacccacccgggtactgacgcagatcctgtctttccgcaccgacctcgggatacttcgcgcagatcgcgctggcgacagccgggtcgaccgcacgcgccaagtagacgaaggtctcgtcgctttgcagcttcttcagcacggccgcggcatctggcttgttgttcagcttgccggcgacctcctgggcgatatcgcgcaggcgctgctgcgggtcgggtgcagccgacgtcttcttcctggcctcttccaattgccgccgaatccgcttcggctggaacgtcagggcacgcgcctcgatggtgaacgcgagccggtcattgttgcggtcgacgatgctgccgcgagccgctggctggacgtcggtgaccttgagttggccggccgcctgcgcacgcaggcccgcggcatgtgatacctgcagaaagaacaattgtgttgccgcgaccaacatcaacaccaagatgaccgcgtttccggtccgatgccgaaagacgaacgacgcaccgcgcgtcccgacgtccaccacctgccgggtgcgcctcgcacgagtcgagcgacccgcgggtgcgacgtctgaccgtgtcgcagggcgggatttcgtggcttcctgggcttgccgggctttctgcgttttgccgggccgtttgcgttgcccaacctcctgggctcccggtggccggcgcaaaccgcgcgccggtcgcgtcgactgcgactgactggcccgcctgggggcggcgcggctcacctgggagcccccggcgccgttggcaccggcgccgtgacgggaccgaactgttcgccgttggccggcactggagcgggtggtgccaccatgggttgcgacccacccgacagcccgggcgtcgcagccaccggtgctggtccagggagcccggccgggggcgccgcacccacctggagcggcaccggattttccgctggtgccggggatggcactgcgccgagcggaggagccggcatcggacccggcgccccaggtatcggcaccggaccgggcagctgcgggccggcctgggtgggcaggtgggttgcgccgcccagcgtcgctgtgccgtctggggtacgcaccagcacctccgggccagaccgggcgggcggagcgggatcatcggggcctggtgtcacccggaccggcacctcgaggggcaccgccgcgggtttcgggggcggcggcggatcttcgggcaacttcgtgttcagcggcggcggtggaactccgtcagccggcttgggtgtaccgaccaccacccaattgccgtccggatcctgaaccaggtgggcggtatccctcgtcgggatcatgccctggcgacgagccgcctcggccagcgccggcgccgacgcagcctcgcgtacgtcgcgttccagcgcttccttgtgctgctgcagcatccgggtccgctcccgggcgttgctcagctggtaggacctctcggcggcatcggtggacaaccacagtgtgaggcctagtccgacgccgagcgaaccgataaccagcaccacaaacggaaccttgtttgccaacgtgcgcggccgcaggtcgatcgacgtgagccgggcggcgagacgctccatcggcgtaggacggaccagcttgggcgccttggcttttcgggccttggcccgcgccttggcctggctggtgttctttgcgggggccggccggtcgaacgggctgagcatcgggctggtttgcggtccagggcgcgacacccgggcctgccggccgggtgccgaggtcttgccggcacggctccggatgcggcgcgacggcgccgagttcgtagtcgttcgcctcgtcgccgcggcaggactgtcggctctcctgcgacgatcgctgctgcggcttttcggtgcctcacgcttggccctcatgaatcacccttctcggttgcccattgctgcgattgcgcccggtgctcgactcgttgcagggcccgcaaccgcactggagtactgcggggattgcgttcgatctcagccacactcgctcgttcggcgccgtgcgttaacgaacggaatcgcggctcatggccgggaagttcgaccggaagtcccgcaggggtggccgacgcgactgcctcggcgaacacccgtttgacgatcctgtcctctagcgactggtaggccagcaccgcgatgcgcccaccgatagcgagggcatccagcgcggcaggaacggccgtgcgcagcgattccagctcatcgttgaccgcgatgcgcagcgcctggaatgttcgcttggctggatgcccgccgacacgccgggccggagctggaatcgcctggtacagcagggcaaccagttcggcggtcgaggtgaacggggtttttgcgcgtcggcggacgataccggcagcgatgcgccgagcaaaccgctcctctccgtagcgacgcaggatgtcggctagtgccgcctcgtcgtaagtgttgacaatgtcagctgcggtcaacggcgtcgtcgggtccatccgcatgtccaatggcgcgtccgtggcgtaggcgaagccccgctcggcgcggtcgagctgcatggatgagacgccgagatcgaacaggattccgtcgactgatcccactgcggcataaccggattcagccagcgctgcgcccagacagtcatagcgggtgtgcaccagggtaagtcggtcagcgaatcgcaccagccgagaccgcgcgacgtccagagcggttgggtcacggtcgagcccgatcaggcgcagacccggcaatccctccaaaaaccgctccgcatgcccgcccgcgccgatggtcgcgtcgagaaggaccgcctgcgagccgtctggatagtagcgggttagtgcgggggtaagcagttcgaagcaacgttgcgccaataccggcacatgaccgaaaccggttggccccgaacctggatcagccaccgtgatacctccccaggtctggcaagccgtacttcgggacgcggctattccaggcgccgcccctgcaccgaggtccctgtccgaagacacgaacctggcgttggggaagtacgccagggtcgcttcgggcagagaccacggtgcacgggtttgcacctcagaagatgtcaccgagtgcttcatcgctggccgcggagaagttctcttcatggatttgttggtagttctgccaggcttgcgcatcccagatctcgagatagtcgaccgcgccgatcaccacacagtccttggaaaggcttgcgtagcggcggtggtcggccgacaaggtgatccggccttgactgtcgggatgctgttcgtcggtaccggcggcgagattacgtaggaacgctctcgcctcggggttgcttcgtggcgccttgctggcccggcgcgccagctgctcgaacgccgcccgcgggtaaacggccaggctgtgatcttggctcttggtgaccatcaacccccctgccaacgcgtcgcgaaacttggccggcagcgtcagccgccccttgtcgtcgagtttgggcgtgtaggtgccgagaaacatggggcacctccctgccaaatccatctcacccaaacacctcagccaccataccccacaatcccccactttgccccataactggggtatcaaagcggcgttttgccgtctctgtaccactgaagcgcgcggctagcccggctacgacctcagaaaaccgcatgtcgccgggcaaatgggtggcaagtggggccaag

SEQ ID NO: 28 - DNA, 11754 bp, Helicobacter pylori
tttcttacaacttaactaaaagtaaaaagagttttgttatcatggagcaaatgattagggcattagcaaataatgctatttaaagaggagaaatgatgaaagattttttagaagattacaaaaaaagcgttttagaaagaaaaagtgagggtatcccgccactccctttaaacgctaaacaagtggaagctgtcgttgagattttgatgaaagatcccacaaacgccgctttcgctaaagaattactcattcacagagtaagccctggggttgatgagggggcgaaagtcaaagcggaatttttagcccaattgtctcaaaaaaaactagaatgtccgcacattagcgctttagaagcgaccactcttttaggcacgatgcttggggggtataatgtagagcctttgattgtgggcttagaaagtcaagacaaaaacatcgctaaagagagcgcgaaagctttaaaaaccacccttttagtctatggatcgtttgataaaatcgccgcaatgagtaaaactaacgctttggctaaagaagtgctagagtcttgggcgaacgccgaatggtttttgaataaagagcctttgaatgaatgcattgaagcgtgcgtgtttaagattgatggcgaaaccaataccgatgatttaagcccagcgagcgacgctttcacacggagcgatattcctttacacgccaaagccatgctaaaaaaccggattgaaaattacgaacaacgcattgaagccattaaaactaaaggcgttcctgtagcgtatgtgggcgatgtggttggcacaggaagctctagaaaaagcgcgactaactctatcatgtggcattttggtaaggacattccttttgtgcctaataaaaggagtggaggcattgtgattgggggggtgatcgctccgattttctttgcgacttgtgaagatagcggggcgttacccattgtggctgatgttaaggatttgaaagagggcgatatcattaaaatctacccttataaaggcgaaatcacgctgaacgataaggtggttagcacctttaagctagagcctgaaactttattagatgaagtcagggcttctgggcgtatccccttaatcattggtaggggtttgaccaataaagcgcgtaaatttttagggctaggcgaatcggaagcgttcaaaaaaccatccgctcctaaaagcgacgctaaaggctacactttagcccaaaaaattgtaggccatgcttgtggggtaaaagggatcttacctggtgcttattgtgagccaaaggttaccaccgtgggcagtcaagacaccacaggggcgatgaccagagatgaggttaaagaattagcgagtttgaaatttgatgcgccttttgtgttgcagagtttttgccataccgctgcttacccaaaacctagtgatgtgagtttgcatgcaaccttgcctggctttatcactcaaagagggggcgtggcgttgcatccgggcgatggcgtgatccatacatggcttaatcgcatgggattgcctgacactttaggcacagggggggatagccacacccgtttccctttaggcatcagtttcccggcagggagcgggctagtcgcttttgcagcggttacaggcacgatgcccttgaacatgccagaatcggtgttagtgcgttttaaaggggaaatgaatcctgggatcaccttaagggatttagtgaatgcgatcccttattatgcgattaaaaaagggttactcacggtggagaaaaagggcaaaatcaatgtctttaacgggcgtattttagagattgaaggcttgcctgatattaaaatggagcaggcttttgaattaagcgatgcgagcgcagaaaggagcgcagccgcttgcgtggtgcgtttgaataaagagccgatgattgaatacttgaaatccaatatcaagctcattgatgagatgattgcaagcggttatgaagacaaagagactttgaaaaaacgcagagatgcgatgcaagcttgggtggataagccggtattgttagagccagatagtaacgcccaatacgccgctgtcattgaaattgatgtggcagaaatcacggagcctattttggcatgccctaatgaccctgatgacgtcgctactttgagcgaagttttagcggatacgaccggcaaaagaccccacgctattgatgaagtgtttattggctcttgcatgacgaatattgggcatttcagagcctttggtgaaatcgttaaaaacgcccctcccagtcaagcacgcctttgggtagtgccacccagtaaaatggacgaacaagagcttattaatgagggctattatgcgatttttggggctgccggggcaaggactgaagtaccaggctgtagcttgtgcatgggcaatcaagcgagggttagggataatgcggtcgttttttctacttccacacggaattttgataatcgtatgggtagaggggctaaagtgtatttgggcagtgcggagcttggggcggcgtgcgctttactagggaggatccccactaaagaagaatacatgaatttagtgagtgaaaagctagagagccaaaaagacaagatctatcgctacatgaactttaacttaatggagaatttcaggctctagttttgttttcattaaaagggaatgatcccttttatttggctatgactgagtgttgagagaggataaaaaggagagcggtgatgaaaaaaatcgttgtgagtttatgcgtggcgttaggttttttaagcgcggatccagcgcaggccaataaagcgatcagtgatgcggatttgattgaagagataagggacttgaaaaaaatcatcagcgcacaaaacacggagattaaccaattaagaaaagtgcaagaagtcttatctgggcaattaggggacatgcgtaaggatatattaagcactagagattactgtatcagcttaaggccttatatttataattggcgctaggggatcatcaaagcatgaaaagcgtgtaccattcaatcctttgatgaccattcaatcctttgatgaccattcaatcctttaatgattaaagaaattaaagttgggggaggtttggttttggctctgtatccctataatagggattttacagggtttgagtattccaatgcgtttaatcccacacgccttagaaaaatcctcttgttggattgtaggggtaaaattaatccccttgttagggctaaatgtcctataataaggttttaggaaattcaagtttaaagatattaaaaaatgccatacgccttaagaaaaagatttttcaaacgccttttattgttttttttaattgtttgtatgataaatttgcatgccaaaagctatctgttttctcctttgcccccagcgcaccagcaaatcattaagacagagccttgctctttggagtgcttgaaagacttgatgctgcaaaatcaaatcttttcttttgtatcccaatacgatgataacaaccaagatgagagccttaaaacttattacaaggacatcttaaacaaactcaaccccgtattcatcgcttctcaaactccagctaaagaaagctatgagcctaagattgaattagcgattttactgcctaaaaaggtggtgggccgttatgcgattttagtgatgaacacccttttagcgtatttgaacaccagaaacaacgatttcaatatccaagtctttgacagcgatgaagaaagccctgaaaaattagaagaaacctataaagaaattgaaaaagaaaaattcccttttatcatcgctttattgactaaagagggcgtggaaaatttgctccaaaatacgactatcaatacccctacttatgtgcctacggtgaataaaacgcaattagaaaatcataccgagctttctttaagcgagcgcttgtattttggggggattgattataaagagcaattaggcatgctcgcaactttcattagccctaattcgcccgtgattgaatacgatgatgatggcctgataggtgaacgcttgaggcaaatcacggagtctttaaacgttgaagtcaaacaccaagaaaacatttcttacaaacaagcgaccagtttttctaaaaattttagaaaacatgatgcgttttttaaaaattctaccttaattttgaacacccctaccactaaaagcggtctgatcctttctcaaatagggcttttagagtataagcctcttaaaatcctttccacacaaatcaatttcaacccctctttactcttgctcacccagcctaaagacaggaaaaatttattcattgtcaatgccttgcaaaacagcgatgaaacgctgatagaatacgcttccttattagagagcgatttaaggcatgattgggtgaattattccagcgcgatagggctagagatgtttttaaacacgctagatccgcattttaaaaagtcttttcaagagagtttggaagacaatcaagtccgttaccacaatcaaatttatcaggctttagggtattcttttgagccgataaaaaacgaaagcgaaacaaaaaaagaataatatttagataattatttgaatacttttatttttaatgggtttttaagaaagatagactattatgcgagtgggaaattaaaaaggattggtgcggtgttaaaatttcaaaaattacccttattgtttgtttccattctttataatcaaagccctttattggcttttgattataagtttagtggggtagcggaatctgtttctaaagtggggtttaaccattccaaactcaattccaaagaagggattttccctacagccacctttgtaaccgccacgatcaagcttcaagtggattccaatctgctccctaaaaacattgaaaaacacagcttaaaaataggcgttggggggattttaggagcgctcgcttacgattccaccaaaacgctcatagaccaagccacgcatcaaatctatggctcagaacttttttacctcatagggcgttggtgggggtttttaggcaacgctccttggaaagactccctcatagaatctgacgctcacacccgtaattatgtgctgtataattcctatctgttttattcttatggcgataaattccacctaaaattagggcgttatctctctaacatggattttatgagttcctacacacagggttttgaactggattataaaatcaattctaaaatagcgttaaaatggtttagctcttttgggagggcgttggcttttgggcaatggatacgggattggtatgcccctattgtaactgaagatggcagaaaagaagtttatgatggcatccatgccgcgcaactctatttttctagcaagcatgttcaagtcatgccttttgcttatttttcgcctaagatttacggagcgcccggtgttaaaatccatattgatagcaacccgaaattcaaaggcttagggttaagggctcaaaccactattaatgtgattttccctgtttatgctaaagatttatacgatgtgtattggcgtaactctaagattggcgagtggggcgcatcgcttttgatccaccaacgctttgactacaacgaatttaactttggctttggttattaccaaaattttggcaacgctaacgcaaggattggctggtatggtaaccccatcccttttaattatagaaataacagcgtttatggtggggtcttcagtaacgctattaccgcagacgccgtttctgggtatgtctttggtgggggggtgtatagagggtttttatggggtattttaggcagatacacttatgccactagagcgagcgaaagatccatcaacttgaacttgggctataaatggggttcttttgctagagttgatgtgaatttagaatactatgtggtcagcatgcacaacggctatagattagactatctcaccggccctttcaacaaagcctttaaggctgacgcacaagataggagtaaccttatggttagcatgaaattctttttttaaaccctatcaattaggtttggtagaattgagccattgtttttggaaatcaatggcttttctcaattcggcttctagctgggctaaaacatcttttaagggcttaacatcaatcaaattgtcttgcttgaaagaatccagctgtttgtcaatttgcaaagcggcatctagcgcgtcttgggggaataccggatcgcctaaagcctttttaatcgcttcgccgatttcaatcgtttcagagccttgatgatcttttaagttaggattattttctttgtccttaggcttaggctctaaaatcaagcgcaaatgtttgattttttcatgcaaatcgttaagatcttttaagtgatcggtattgcgccccctatccaccgctttttctaaaagcttatcgctcaggctcactaactgatcgcttaatttaatgctattagcttgagcttctgttacttcatcaatatcaatcgctgctaaagcgctcacaaaataaaagggcaacgcccaccttctaaaacgagagaaaaacttctgcatttaccttccttaaatacgctataaaaatgatacttttttaatatggtggagctgtggggaatcgaaccccagtccaaaaatcttgtcctaaacacaaacttctacaatgcttagaaaattgattagctttttagccttaaaactagttctggtccaactttctaaaaccttgagatagtttcaagagttcttgtttcttagtttaaaaggcgaaccaccttttaaaagcgtctagcttaaggttatggagcgattaaaacgctagaaattctaatcagtccagctccaaaaggagattaactcacgcagctttagcgtaagctggagcgtaatctgcgttgtttacagttatttttgttgctgttttacaagcagcgcttggcatgctatctgtgcgacaagaaatctgtcgaaatccaagtcagccccatgattttaaaagcttagttattgtaactaacttttattaatgagcggctaaaaatcactggcgtacaatatcaatattttcatctttagggttaaaaacaaagatttcattaggaattttagggttgatttctgcttgagaaaaagtgatcgtaacaagattattcatgtcatctttaaattccaacgaaaaaggcttgccgtctttaaaaaccaaacgataagtggtcttgttgatagtcgttttaaaagagccgtcagtctgctttttcaattgcttgagaatggtgaaaaaatccgtcttgtcttttaagggcgtgatagtcgcttggaataaattaggctcataaaccaccacttccttatcgttcatgtaaatttctttttttaagggtttttcataaacccataaagcccaattaggggctttagcctttaaaaccccataataaactaagggcttttcattttttaacacttgcttgaaatgcgcgctaaaactttgcaaattttgtaaaacttcttcttctttagaaagggttaaaggatttttagcatgagcgacacccacaaaaatcaaaaccatgcaaatctttaaaaaagctttcattaatcaaaccttaaaataatctctcatctttaataaaaccctttattttacaagacttttattttatccatgctaaaatgggatcaaaaactgacgctttaatcaaataaatgggattgaagcactcttaaaaggttactactaccatgataaaagcaatcattggaaaaatcatcggcactagaaacgatcgctggatcaaacaatacaaaaaaaaagtcctagccatcaacgccttagagcctacttatgaaaaaatgagcgatgttgagctgcaaaacgcttttgaagaattaaaaaaacgagtgcgatccgtagaaaaagatttgcaagaaaaaacccttttagaagttttaccagaaagctttgctatcactagagaagcgagcaaaaggatcttaaagatgcgccattttgatgtgcaactcattgggggcatggtcttaaacgatggcaagatcgctgaaatgaaaaccggagagggtaagactttggtcgctactttagcggtggctttgaacgctatgaaaggcgagagcgtgtatgtggtaaccgttaatgattacttagcccatagggattctaaagaaatggagccgttgtatcaattcttaggttatagcgtaggcacgatcactgcgagcgtgcgagatgatgatgagcgcttagaaatttattctaaagacattgtttatggcactaataatgaatttggctttgattatctaagggataacatgaaatattctttagagcataaagtgcaaaaatcccatgcgttcgccattgttgatgaagtggattccattttaattgatgaagcgagaactcctttaatcatttcagggcctgtggataggcgcatggaaaattacaacaaggctgatgaagtcgctaaaagcatgcaagtggaagtggatttcaccatagacgaaaaaaaccgcgcgattttaatcactgaagaggggattaaaaaagccgaaaatctctttggcgtggataatttatacaaaattgaaaacgccgccctatcgcaccatttagaccaagccttgaaagcgaattacctcttttttattgataaagattatattgtagccaataatgaagtggtgattgtagatgaatttaccggccgtttgtctgaggggaggcgctttagtgagggcttacaccaggctttagaggctaaagagggcgtgagcattaaagaagagagccaaaccttagccgatattactttccaaaattatttcaggatgttttctaaactttcaggcatgacaggcacggctcaaaccgaagccacagaatttttagaaatctacaatttagaagtggtgtccatccctactaatctagcgatcaagcgaaaagatttgaacgatctgatctataagagtgaaaaagaaaaatttgacgctgtgatccttaaaattaaagaattacacgataagggtcagcccgttttagtcggcacggctagcattgaaaagagtgaaaccttgcacgctttactcaaaaaagagcgcatccctcacaccgttttaaacgccaagcaacacactaaagaagctgaaatcatcaaagacgccgggcttaaaggggcggttacgattgcgaccaacatggcaggcaggggcgttgatattaagctcactgatgaagttaaagaacttggggggctgtatatcattggcactgaaaggcatgagagccgtaggattgacaatcaattaagggggcgaagcgggcgtcaaggcgatccgggagtgagtcagttttatttgagtttagaagacaatctgttacgcatttttgggagcgataggattaagggggtgatggaaaaattagggcttaaagacggcgaacacattgaatccaagctcgttacaagagcggtggaaaacgcgcaaaaaaaagtggagaacttgcattttgaaagccgtaagcatttgttagaatacgatgatgtggctaatgagcaacgaaaaagcgtgtataaatttagagatgaattattagacatcaattacgatattagcgctaaaatcgctgaaaacagagaatacgcgctcaatcaaatcttttctaaactcaaagcctttgaccatcaaaacctgtctgaagaggaacttttagggcttaaaaacattttaaaagaagattttaacgctagcgttgaattagaagatttagaaaaagcctcccctattgaaaaatttgtggctgaaaaactcaaaagcgattatgaaaacaaaatgaaagctttggatagcgaacaaagaagccggatcgaacgcatcgtgtatttgcagattttagacaacgcatggcgagagcacctttatacgatggataatctcaaaaccggtatcaatttgagaggctataaccaaaaagacccccttgtagaatacaaaaaagagagttacaaccttttcttagaactcattggagacattaaaatagaagcgatccaaaccttttctaagatccagtttgaaaacgagcaagattctagcgatgccgagcgttatttggataactttagcgaagaaagagagcatgagagcgtaacttaccgccatgaagaagccttagatgaagatttgaatgtggccgtgaaagctttttctaaaacccctaaaagaaacgagccttgcccttgtgggagtggcaaaaaatataaagattgttgcgctaaaagcgggcctaaaaagggcttatttgccaaatagatccttaatctttttccttatcaagcgttatttgcgttttgataaaagccagcctttcattagtatcactgctttgttagccttttttggcgtggcggttggcgtgatggttttaattgtggctatggcgatcatgaacggcatgagtaaggaatttgaaaaaaagctttttgtgatgaactaccccttaacgctctataccacaagcccttatgggatcagcgaagaagtggttcaagctttagaaaaaaagttccctaatttgctttttagcccctatttgcaaacccaaagtccgattaaaagcgcgcattccatgaatggcggcgtggtgtttggggttgatttttctaaagaaaggcacatcaatgaagttttaaatgacgccttaaaaaacattaatgaaaacgatctcttcaaaaacccttttaatttgatcgtggggaaaagcttgagatacagcttgaatttagatctcaatcaaaaagccgatttgtttttcaccgaattagagccaacaggtctcacgctctcccccatcatgaaacgctttactatcaaaggcgattttgattcagggctaaaatcctatgacatgagctacatgtatgcgagccttcaagctataagcgcgatcaggagattacccttagggctttatgatggggtgcatgtctattctaaaacgcccatgaaggatattgaaaaattacgcaacgctttaaaaacaatcaaccaccatggcataggcattgaagggtggtggcaacaaaacgggaattttttctcggcgatggaattggaaaaaagagcgttattcattgtgctcatgctcattattttaatggcgtctttgaatatcatcagctcgcttttaatggtggtgatgaacaggcgtaaagaaatcgccctactctttagcatggggagcagtcaaaaagaaatccaaaaaacctttttttatttgggtaatatcattggtttaggcggtgtgattcttggggtggttttagcgtttataagcatgtatcttttaagcgtgttccctatcatctcgctcccggcagatgtctatggcatcaacactttgcctttagatttgtctttaatggattttacgctcactctaataggctctgtgattatcgtagccctttcttcttattacccgtctaaaaaagcttctgctattgacgctttaagcgtgttaaggaatgaataaattaaaaaattaaataatattgagatgaaataaggctttgattgtccatatttgactaacaaagaaaaattttattctcaaaattaaaaaaaacaataatattatgctagtattaacgcacgacttagttaagaattaactttgtaagtcggacttcgtagaaaaaagg

SEQ ID NO: 29 - DNA, 10516 bp, Helicobacter pylori
cactcttaagaataagctaaatcatgctagaattatacttgaatttattcctagtttaatttatttcttaatacaaaaggtgagcgttttgaaacatttagccccactcattcatatcccttttaaagccttatggctaggcacagccttaagcatgttcttaagtttgaatttgaacgctgaagaaaaccctactaaaacagagcctaagcccgctaaaggggttaaaaacaagcccaaatcgcctgttactaatgtcatgatgaccaattgcgataaccttaaagactttaacgctaagcaaaaagaagttttaaaagccgcttatcaattcggatctaaagaaaatttaggctatgaaatggcgggcattgcgtggaaagaatcatgcgcagggacttataaaatcaatttttcggatccgagtgcgggcatttaccatgcgtatatccctagcgttttaaaaagctatgggcataataatagcccctttttgcgtaacgtgatgggggaattgctcattaaagacgatgcgtttgcttctgaagtggccctaaaagaattgctctattggaaaacgcgctaccatgacaacctaaaagacatgatcaagtcttacaataagggcagtcgttgggaaaaaaacgagaaagctaacgctgatgctgaaaaatattatgaagagatacaagatagaatcaggcgtttgaaagaatctaaaatctttgactcgcagtctagtaatgaccaagaattgcaaaaaagcgctaatagcaatttggatctagaccctatcggcaacgccatgccccaaactttagctcaaacagagacccaaaaatctcaaatagaaaaatctcaaatagaggaagctcaaacgcaaaaatctcaagaaatgaaagaggcagctagcgagcaagccattaagaagccgctagaaaaagaaaaagataaacccatgtatttggctcaaatcaatagtgctgatttcgcgcccgctaaaaaaagcccaaaaaaaccggctaaagcgagtccaaaacgctcctctaaaaataatatcagcgttaaaagcaacaccaaaaccgcttccaaaaataaagaagtgtgcaaaaattgctctccagggcaaaggaatgcgattttagctaaccatatcaccctcatgcaagagctttaaaaagtcctaaaaatggcgcaaaaaactcttttgattatcaccgatggcattgggtatcgtaaagatagcgatcataacgctttcttccatgccaaaaaacccacttatgacttgatgtttaaaaccttgccctatagcctgattgatacgcatggcttgagcgtgggcttgcctaaggggcaaatggggaattctgaagtggggcatatgtgcattggggctggtagggtgctgtatcaggatttagtcagaatttctttaagccttcaaaacgatgagttaaaaaacaaccccgcttttttaaacacgatccaaaaaagccatgtggtgcatcttatgggtttaatgagcgatggaggcgtgcattcacacattgagcattttatcgctctggctttagagtgtgaaaaatcccataaaaaagtctgtttgcatttaatcaccgatgggcgcgatgttgcccctaaaagcgctttaacttatttaaaacagatgcaaaatatctgcaatgaaaacattcaaatcgctaccataagcggtcgtttttatgcgatggatagggacaatcgctttgaaaggattgagcttgcgtataacagcctaatggggcttaatcacacgcctttaagccctagcgagtatatccaaagccaatacgataaaaacattaccgatgaatttatcatacccgcttgttttaaaaattattgcggcatgcaagatgatgaaagctttatttttatcaatttcaggaatgatagggctagagaaatcgtgagcgctttaggccaaaaggaatttaacagctttaagcgtcaagcttttaaaaaactccatatcgctaccatgacgccttatgacaactccttcccctaccctgttttattccctaaagaaagcgttcaaaacacgctcgctgaagtggtgtctcaacacaacctgacccaaagccatatcgctgagactgaaaaatacgcgcatgtaacctttttcatcaatggcggagtggagacgccttttaaaaatgaaaaccgggtgcttatccaaagccctaaagttaccacctatgatttaaagcctgaaatgagcgctaaaggagtaacccttgcggtgttggagcaaatgaggctggggacggatttgatcattgtgaattttgctaatggcgacatggtggggcatacagggaattttgaagcgagcattaaagcggtagaagcggtggatgcatgcttaggggaaatcctttcactggctaaagaattggattacgccatgcttttaacaagcgatcatgggaattgcgaacgcatgaaagatgaaaaccaaaaccccttaaccaaccacactgctgggagcgtgtattgctttgttttagggaatggagtcaaatccataaaaaacggagcgttgaacaatatcgctagcagcgtgttaaagctcatgggcatcaaagccccagcaacgatggacgaacccttattttaaactaaaggaaaagaatgcaaattgatgacgcattattgcaacgcttagaaaaattgagcatgctagagattaaagacgagcataaagagagcgttaaaggccatttggcggaggttttaggctttgtagaaaacatcttcgctttagaaactaataatctaaaaacagatacgcatcttagcacccctttaagagaagacgaacccaaaagccaaccccacatcgccaaagagattttaagccaaaacaaacacagccaggatcattacttcgttgtgcctaaaatcattgaataggtttgattgaaaggtttcatatcaggttaaaagcttgatttgtgaaatcaaacagacagaaacaaagctatcgcttgactaaaattaagctttttactatttgttttcagccttttttaattcatcaatcgcttccactaaccccgcaatcgcctttttgatttcttcatgcgtgataatataaggaggcatgagatagatcgtgttgtttaaggggcgcagtaacaagcctttttttagagcttttttaaaaaccgctaaactcaaacgctctttggtttgaagaaaaacttcaaaggcaaagaccatgcccaaatgccttaaatcagacaccacttgccgctctatcaagggttttaacgcgttttggagcgcactaaaaataaactcgctcaaagccttgtttttttcaataacattttctttttcaaaaatatctagcgtggcgttcgcgcatgcgcatgccagggcgtttcctgtgtagctgtgcgaatgcaaaaacgctttattttcttcatagggggcgtaaaattggttatagatttcattatgcgttaatagcgcgcttaaaggcaaataccccccgctaatccctttagacaagcataaaaaatcaggcttaattccgcattgctcataagcaaacatgctccctgtgcgcccaaacccggtagcgatttcatcaaaaataatgtggatgtttttttgcttgcaccataaaacggcttgttttaaatatttcgcgctataaatatgcatattccccgcgcattgcaaaagcggctctgcaataaaggcgcaaatttcttcaccatgcttatccaacaaacgctttaaagcgttcaaactattttctatctcgctgtcgtttttaggcacgggcgtgatgagatttttgagcaataagggggtgtaagtgtctttataaagtttcacatcgcccacgcttaacgctcccaaagtctcgccatgataggaattagaaagtgataaaaaaagctttttgcggcgcgtttggttttttaaaaaatgggcgtgatagctcattttcaaagcgatttcaatacaagatgagccgttatccgcataaaagcatttatccataccggtgagctggcaaagcctttgagagagcgtaatgatgggcttatggctaaaagaggccaaaaggacatgctctaaattatcaatttgatttttaagctgttggctgatgtaggcgttattatgcccaaaaagattcacccaccatgagctgattaaatccatgtaagcgttatcgttaaaatcatagaggtaaatcccttgagcctttttaatggggataatggggaaattttgatgctcttgcatttgcgagcaagggtgccaaaggtattctaaatccaaagcggccagattttcttgaaaattcatgttaaaaactctctataataaggataattttaataacctttggttaaaataaggttatttgattttactataaggttgtttaaacctgaatttcacatttttgattttttaaaagggattagagttcttatgattgaatggatgcaaaatcatagaaagtatttagtggttacgatatggataagcacgatcgcttttattgccgccggaatgataggttgggggcaatacagcttttctttagatagcgatagcgctgccaaagtgggacagattaagatttctcaagaagaattagcccaagaataccgccgccttaaagacgcctatgctgagtctatccctgattttaaagaactcaccgaagatcaaatcaaagccatgcatttagaaaaaagcgcgctagattcgctcatcaatcaagctttattgaggaatttcgctttagatttagggcttggtgctaccaagcaagaagtggccaaagagatcagaaaaacgaacgtttttcaaaaagatggcgtttttgatgaagaattgtataaaaatatcttaaaacaaagccattaccgccccaagcattttgaagaaagcgttgaaaggcttttaatccttcaaaaaatcagcgctctattccccaaaaccaccacccctttggagcaatccagtctatcgctttgggcaaaattgcaagacaaattagacattcttatcctaaatcctaatgatgttaaaatctctctcaatgaagaagagatgaaaaaatattatgaaaaccatagaaaggattttaaaaagcccacaagctttaaaacacgctctttatattttgacgctagtttagaaaaaactgatttgaaagagttggaggaatactaccataaaaacaaggtgtcttatttggacaaagaggggaaattacaggattttaaaagcgttcaagagcaagtcaagcatgatttaaacatgcaaaaggcgaatgaaaaagccttaaggagctatatcgctctaaaaaaggggaacgcacaaaactacaccacgcaagattttgaaaaaaacaactccccctatactgctgaaatcacgcaaaaactcaccgctctcaagccccttgaagtcctaaaaccagagccttttaaagatggttttatcgtggtgcagcttgtctctcaaattaaagacgaattgcaaaattttgatgaagccaaaagcgctcttaaaacccgtctgactcaagaaaaaacccttatggcgttgcaaactttagctaaagaaaagcttaaggattttaaagggaaaagcgtgggttatgtaagccctaattttggaggcactatcagtgaacttaaccaagaagagagcgcgaagtttatcaacaccctttttaaccgccaggaaaaaaaagggtttgtaaccataggtaataaagtggtgctttatcaaatcacagagcaaaatttcaatcacccctttagtgcagaagaaaaccaatacatgcagcgtttagtcaataacactaaaacggatttttttgataaagcgttgatagaagaattgaaaaaacgctataagatagtcaaatacattcaataaatgcaaggggaaatcatggaacataaagaaatcgttataggggttgatataggctctagaaagatttgcgcgatagtggctgaatttaaagacgggattttacgcatcattggcacggctcatcaagactctaaagaaatcaattcaaaagccattaaaagagggcgtatcaatagccttgctcacgcttctaacgccattaaggaagtgattaatagcgctaaaaaaatggcaggtttgaacgctgatgaagacagaaacaatcccatttcctcctttagagaatcgtatcaccctaaaactaaggcgatcgtttctttttctggggcttataccgaaagcattagagatgttactggtgtggccagcaccaaagacaatgtggttactatagatgaaatcaatcgcgctatcaataacgcatgcgctaaagcaggcttggataacgacaaacacattttgcatgccctcccttatcgcttcactttagacaaacaggaagtgaacgaccccttagggatgagcgggactcgcttagaagtctttatccacattgtctatacagaaaaaaacaacattgaaaatttagaaaaaatcatgatccaatctggggtagagattgaaaacatcgtgatcaattcttatgcagcctcgattgccaccttgtctaatgatgaaagggaattgggcgtggcttgcgtggatatgggcggagagacatgcaaccttacgatttatagcggcaattctatacgctataacaaatacttacccgtaggctctcaccatttaaccacggatttatcgcacatgctcaataccccattcccttacgctgaagaagttaagatcaaatacggggatctttcttttgaaagcggcgcagaaacgccctctcaaagtgtccaaatccctaccaccggctcggatggccatgaaagccatattgtgccgcttagtgaaatccaaactatcatgagggaaagggctttagaaacctttaaaatcatccacaggagcattcaagatagcggatttgaagagcatttgggtgggggcgttgtgttaaccggcggcatggctttaatgaaagggatcaaggaattagccagaacccatttcactaattaccctgttcgtttggcaacccctgtggaaaaatacaatatcatgggcatgtttgaagacttgaaagatcctcgcttttcagtcgtggttggcttgattttatacaaagcaggggggcataccaattatgaaagggattctaaagggattatccgctatcatgaaagcgacgattatataagaaaagcccaccaatcaaaccctaccccccacatccattcatcgcccacagaaaggaatttaagcgatttaaaaacccctagcgctcctttaaacaccgctaaaaatgacgacttcttgcccataaaacccactgaacaaaaaggtttttttcaaaacctcttggataagatttctaaaatcttttaggatatagcgatttctttatgcgataaaacggcttgatagttatcaaaagctagaaaacatggtataatccctagctatctatacaaagtttaagatttgcaaaaatcgtctcaaggggaaagtagctatggttcatcaatcagagatggaaaattataatatcggtcaagcgagcattgaagaagtaagcgatccagcttataaaggggctaagattgtcgttgttggtgttggaggtggggggtctaacatgattaaacacctggttgaatacggcgtacatcaagatgtgacccccattgcaacaaacactgatggccaacacctcaaaaacaatcccgccccagttaaaatccttttaggcaaagaatctaccggaggtttaggcgctggaggggttcctgatattggtaaaaaagccgctgaagaaagcgctgatgaaattagagaagcgattaaagacgcgaaattagtcattgtctctacaggacttggaggggggactgggactggagccacccctactatcgttaaaatcgcaaaagaagtgggagcgctcacgatcgctatcgttactaagcctttcaaatatgaggggaatcaaaaaaggaagagggctgaagagggattgaaagaattggaacaatctagcgattctattttggttatccctaacgataaaatccttctcaccatgaaaaaaaacgctagcaccacggaatgctatagggaagttgatgatgtcttggttagggctgtgagcggcatttctacgattatcaccaaacccggtaatatcaatgttgattttgccgatttaaagagcgctcttggttttaaaggctttgcgctaatgggtattggtgaagccactggcgaagattccgctaaattagcggtgcaaaacgcgatccaatcgcctcttcttgatgacgcttctattgaaggagctaagagcattatcgtcttttttgagcaccaccctgactatcccatgatggcttattctcaagcttgcgatttcattcaagatcaagcccaccaagatgttgatgttaagtttggacagcacacgagcgagaatatccccattgatcatgtgcgcgttactatcattgcgaccggttctgaaagaaacagcaacggagcgggtttggaatctatcgctacgccttctcaacctgtggtgaaaccaacaagaaaagtgggcaatggcgagtatttaagaatccctactgaagaagagctgtccatacccacaaccataagaatccaacaagattgattgcagatcttgctttcctcccctatttttatagggctatatagggctatgataaagcggttttgggtttgctctcattgatcattaataataaaaatttaggataaaatcaaaaggctttgggtgtgctgacttttagagcgttttatggggattttaggacgctttaaagggaaatcatcgcaaataccccctattgttaatgaaacgctagaaagccgttataggttatatctttatccaacgcatagataagagatgggttttctctacttgttgttaggcttgttggtattgtttaacacgctcgcaataaagccaacgctcacgccttaccttgtgccaaagcgttagaaattttaatgatttcaaggttttgtttcgcgctcaatctataagtcttactcaaattccgcctctcatagtctcggcttttaatggtttctttttcccatccacttatctcatcaatggtaaaaactttagggtatccatacgcacgagccatgctctgtctccctttgatagagcctacaatatagctctcaaaaggttcgctaagcctatcaataggtaagatagctgctttgatttgcgttttagcgattccatcaaaatctgtgccataaccgctattgggttgttttttgaaaaaggtataaaccttgtcttttaatcgtgtgagaaattgaggtaattgtacaggcgctgaaaaagcaatgccattgaatgtatcccacacttcaccataactaccaggctcagtgctgattaaatccacttcattagcgcttgcgttttgacaatagcaaatagccgcttgactaaacgctctagctaacaccaataaggtcttttttaaattaaaggtatcactaggttcgttttgaaatacgaaaaagctcgtttctttatcagttaaaaggccatcttttaggctccaataccctaccacttcaatataacccagaaaatcccgcttaaagtttaaaaatgatttcggctgtcgtgtcctttccatattgtccttgcttgtgtagcggtatcttttgacaaattccttactggacataaaatctttcattggggcttcacttttaggatttaagaatttattaacaaaaagttttcctaaccccttacagagtttggcgtagatagttccattacccctcaaaaaggcgtcagcatcataataggcgtctatgaaattagagttgccattccaatttttggttactcggtctgctttagaatgtttataaccgctcatatacgcttcaatcagtttttctcgttcctcttcagtaaaatcagtaataaattcaggtttaaaaggtctaaacgccgaaatagtcccaaagggtagcccgtttttaatcttattcaccaccctagaaagattggcgctctcaatagtagagcctttaataaggttcatcttataacttaaaatcaacctgtcaatgctgttcgaacaatgcagaaatttcattttctcatcaatggctctgactttagagccttccattctttccaaaaaatcatagttcaatagcataactcgctcctttttgttattgtttaatgataccactctattacttgcgccgttctttaacgctgacttttcttatcatactcgtttagttgagccaataaagattggttaggattgacagagattttaaagagaggtagctgttttttagcttccctaatattccttgagattagtatcaaggatagatgataacgaatggg

SEQ ID NO: 30 - DNA, 14577 bp, Helicobacter pylori
gatgatgcctgtaagttgttgggtgttacgcaagcttatgaggtttgatataggagcgtttttgctctaaactagtttctagttcatctataataatcaattttataaaaaaattgataggatttaaaaaggtcgtttgcgtttaatttaggtgggtaggtttttgggcgtatgctgatgttaaaaatcatagaatccccttatataggaatgatttaaaatcccatttagggttattatattttttgtcaagcgatagcgttactgacagacacgatttgagcgagtggaacgattttaaaaagcatttcaactctaaaaatagacaaagccaaggctttaaataagaaagaccccaaaaaagctagagaaacggagtttttgattttttattatcaaaaccctaaataccctctcgttttttgcccgctattggcttttatgggtgttttagcatataaaactccaacgctttttcaaagagaagcgatcgattaggaaaacctttctctttcatgtattcatccactttagccatgaaactgggcgaaagcaaaagattgtgatggattcttcgctctttgctcattttttcttcgtattctatctcttctatttcggctaacaaactcggcgagagcgaaacgttaaaactgctccttcgttcgctgctcacctttatttctgcttctaactcggctaattcggttagcaaccttttgcgtttggcttgtaaagcctgaatggttgtgtgcgctttatggtgttccattattactccttaaagtgtctttatttttttacattctactataaaataggattttgtgggtaaatcctattaagaatgaaaattggaatttttctttagaatttaaatgggtattaaacataaaatcttaaaacaaatggtaaaggagcttgattttaataagcgatgatttttaatccaattccttaaggcgttttaacaattcttcttcattcaaaacgctcacgccatgtttttgtgccagagcgagttttgagccggcgttttctccagcgattaaaaaatcggttttagcgctcacgcttgaagcaatttttgcccctaaattttctaacatttgagcatattcttgccgtggtttagaaagcgtgccggttagaacaatcgttttatcactgaaaacagaagagcttttttgcttttcttcagccgtatcgctacttttagggtttaacaactcaaataacgatcggataaattcctgattgctcgcataaaaattgactaaagaatgcgccatttccaccccaaagccttccatttccaaaaactcggcttcgcttttttctaacacatttaagccgtatttggctagcgttttactcgctcctttaccaatatgctcaatccctaaagcgttgatcaaacgccataaaggagggtttttgctcttttgaatagcgtctaatagattttgagcttttttgattttgaatttgtctagccgcattaagtcttctaattttaaagcatacagatccaaggcgttgaaaatgagtttttcttcaaaaagttgctctatgactttatcgcccaagccttgaatgtttaaagcgtccttagaagcgaaatgaatcaagctttctttcaaccttgccgggcaattaaggttttgacaataggtaaaaatctcttcgcataaaagttcatgcgagcatatggggcaaactttggggcgcatgattttttgttgcgagccgtctctataagattctaaaggtttgatgattttagggatcacatcgccgcttctaatgacgaccaccctatcattgagcatgatattctttttttcaatttcagaataattgtgtaaggtcgctctattaaccatagctccagcaatttccacaggctctaagagagcgaccggggtgatcgccccactgcgccccacttggttaatgactcctacaattttggtgtgtttttctagagccgggaatttataagcgcaagcgaatttaggggatttttgcgtgtagcctagctccttttgaatatccaattcatccacaacgatcaccatgccgtctaaaagggcaaaaaagccctccctttctctaatcagggtgtggtaattttcttctatttcttggtggtttttgttcaggcttaaatattgaatagcgctaaaacctaacgagacaataaaatccaaacactccttaaatcttaggaaatgtaaagaatgcttgcccacgccccaagggatgaattgcaatttgcgctttttagtgatattgctatcaagctgtcttaaactccctgatgcagcatttctggggttagcgaataggggttcgttagcgtttaggcgctctttattcaaggcgtcaaaatcctctttagaaatgatcacttcgcccctgatttctatttctccattataagcgatagaatgggggatattagcgatgtgtttagcgttgttagtaacaagctctccttctaagccattacccctagtggtcgcgcttattagcttgccatgttgatacaaaagattgagcgaaaccccatcaagtttgggcgaacacacgaatgaagcgttaggataaacttttaaaatgcgttgcaaccacgctcgcaattcgttttgattgaacacatcatctaagctccacatccgcattaaatgggggtttttactgaactcattggtggcagtagcccccactttttgggtaggggagttagcctgaatgcgattagggttttcttcttcataagcttttaattcttggtaaagttcatcatagaccgcatcgcttacgatgggttcatcaaggttgtaataatggtgcgatagggtgtttaaatattcaattctttctaaatattctttttggctttttatcattaaaaaccttttaaactaaattagggtagtattataacatttaatctttgatagggcttaggggaaataggtggtaagagacattgacaaaacgacttcgttgcacttgaacaacgaagcacaatttctatgctttagattagatgcagaaaaagacgcccagctttatggcatgaatatttttaagatccgagaaattatccattatgacggggaggttacagagattcttggagggagcgatggcgtgatgcttgggtttcttagcgttaggggtgagtctatccctttagtggatgtgaaaaggtggttgcattataacgccaatgatccgagtcgtgatttaaaagaatgcagcgttaaagatgatcataatctggtgatcgtgtgccatttttctaaccattccatcgctctaaaggttttaaaaattgaaaggattattcataaaaattggactgagattagcgccggggacaaacaaggcattaatgaagagggtaagcttagcgctatcacccgttttgatgaacaacgagtggtgcagatcttagatgtggaaaaaatgataagcgatgttttccctagcttgaaggatttagacgatttgactttgcgttgcatagaagccattcaaagccaaaaactcattttaatcgctgaagattctttaagcgctcttaaaaccctagaaaagatcgttcaaactttagaattgcgttatttagcctttccaaatgggagggaattgttggattatttgtatgaaaaagaacattaccaacaggtcggcgtggtcattacggatttagaaatgcctgttatttcagggtttgaagtgctaaaaaccattaaagctgatagcagaactgagcatcttcctgtgattatcaattcgtccatgagcagcgattctaaccgccagttagcccaatctttagaagcggatggttttgtggtaaaatctaacattcttgaaatccatgaaatgcttaaaaaaacgctttcataaatttaatttttgttttaatttaaagggataaaacatgcgaagtcatttctgcacagaaattagtgaaaaagatgtgggtaaaaccatcaaagtggccgggtggtgtaacacttatagagaccatggaggcgtggtttttattgatttaagggataagagcggtttagtgcaactcgtctgtgatcctagctctaaggcttatgaaaaggctttagaggttaggagcgaatttgtgttagtggctaaaggaaaagcgcgtttaaggggtgctgggttagaaaaccctaaactaaaaacgggtaaaattgaaatcgttttagaagaattagtcattgaaaataaaagcgctaccccaccgattgaaattggcaataaaagcgtgaatgaagatttgcgcttgaaataccgctatttggatttacgctctttgaacgcttatgaaatctttaaattgcgcagcgaagtggctttaatcactcgtaacgctctggcccaaaagggttttttagagattgaaacccccattttgtctaaaaccacgcctgagggggctagggattatttagtgccaagcagggtgcatgagggcgaatttttcgcgcttccccaaagcccgcaattattcaaacagcttttaatggtggggggaatggataggtattttcaaatcgctcgttgctttagagatgaagatttgagggcggacaggcagccagaattcacgcaaattgatgcggaaatgagtttttgcgatgaagatgatgtgatgggcgtggtggaagatttgttgcaagagatttttaaagcgattgggcatactatttctaaaccttttaaacgcatgccttataaggaagcgatggaaaattacgggagcgataagccggatttacgctttgaattgcccttaatagaagtgggggattgctttatggacagctcaaattctattttttctaatatcgcgcaagatcctaaagataaacgcattaaagctttgaacgttaagggggctgatgcggtttttagccgcagcgttttaaaagaattagaagaatttgtacgccaatttggggctaaaggcttagcgtatttgcagattaaagaagatgggattaaagggcctttagttaaatttttaagcgaaaaggggcttaagaatattttagaaaggactgatgcgcaagttggggatattgtcttttttggagcgggggataaaaaaatcgtgttagattacatggggcgcttgcgcttaaaagtggctgaaacgcttgatttgattgataaagacgctttgaattttttatgggtagtccatttccccatgtttgaaaaaaccgaaaacggctatcatgccgcgcaccacccctttacgatgcctaaaaatatagaatgcgaagacatagaagaaattgaagcgcatgcgtatgatgtggtgcttaatggcgtggagcttggtggggggagcataaggattcataaagaagaaatgcaaaaaaaagtctttgaaaaaatcaatatcaacgaagaagaagcgcaaaagaaatttggctttttactagaagcgctaaagtttggcgctcctcctcatggaggctttgcgataggctttgatcgcttgatcatgctaatgactaaatccaatagcattagagacgtgatcgctttccctaaaacgcaaaaagcttcatgcttattgactgatgcgcctagccccattaatgaagagcaattaagagaattgcacattcgcttgagaaaaccaatttaaaaggatacgatatgaaacaactatttttgattattggagccccagggagtggtaaaaccactgacgcagagcttatcgctaagaataacagcgaaacaatcgctcatttttctactggggatttactcagggctgagagcgctaaaaagactgagcgaggcttattgattgagaaattcacttctcaaggcgaattagtgcctttagaaattgtggtagaaacgatcctttcagcgattaaaagctctagtaaagggatcattttaattgatggctatcccaggagcgtggagcaaatgcaagctttggataaggaattgaacgctcaaaatgaagtgatcttaaaaagcgtgattgaagtagaagtgagcgaaaacaccgctaaagaaagggttttagggcgctctaggggggctgatgataatgaaagggtgtttcataaccgcatgcgggtgtttttagatccgttggttgaaatccaaaacttctacaaggccaagcatttgcataaaattatcaatggtgaaagaagcattgaagaaatcgtgaatgaaatgcaaaaatatattttgtcttttgcaaattaaaatgcgttccaaagagaatgatctgtgattggtgtctatatcatttctttaaaagaaagtcaaaggcgtttggatactgaaaaactcgttttagaatccaatgaaaaatttaaaggccgttgcgttttccaaatctttgacgccattagccccaaacatcaagattttgaaaaattacttcaagagctttataacgctcaaagtttattgcaatctgattggtatcattcttatgttggcgctggtttgactttgcctgaattggggtgttatttaagccattatcttttatggaaagaatgcgtcaaattagatcaaccggtcgttattttagaagatgatgtaacgctagagtctcatttcatgcaagccttagaagattgtttgaaaagcccttttgattttgtgagactctatgggtgttattggtattaccacgagacaaaattccatgttttgcccaaagaatttgtatttcctccctttgatcattcttttaagaataaccctattttagaaaaatttaaaaaattttttgatgtttctagatttttaaatctttctacccataaagtcatccactatattctcaaaaaaatacaaaaaagctattacgcaacgcatgaaaaagaagccttttttttagagcatttttatctcaccagcgtgtatgtggcttctacagccggttattacttaacccctaagggcgctaaaacttttatagaagccacggagagttttaaaatcatagagccggtggatatgtttatggataattctgcttatcatgatgtggcgaatctgacttatgtgccttgccctgtttctttaagtgagcattctttagacagcaccattcaaaagccccaaaaaaagagcttgaaatcttacccccttccgccccaaaaatcaacttttaagaatcttttttattatagcttgaatgccaaaaaacgcttgaatgccttccaacaatacagcaaacaatacgctcctttaaaaacccctaaagaggtttaaaaagaatgaaaaaactttatggtagaatgccaaagaataccatatttaggagttcatttgacacaagtttatatcatttctttaaaagaaagtcaaaggcgtttggatactgaaaaactcattttagaatccaatgaaaaatttaaaggccgttgcgttttccaaatttttgacgccattagccccaaacatcaagattttgaaaaattacttcaagagctttatgattcttcaagtttgttaaaatccgattggttccattctgattattgttatcaagaattattgccccaagaatttgggtgctatttaagccattattttttatggaaagaatgcgttaaatcaaaccaaccggtcgttattttagaagatgatgtaacgctagaatctcatttcatgcaagccttagaagattgcttgaaaagcccttttgattttgtgaggttctatgggcattattgggggggtcataaaaccaacttgcgcgctctccctatctatacagaggccgaagcgtctatggaaaaaacgcctattgaaaatcatgaagttaccccccccccccaatcccacacaagatgcacaacaaaactctattatggaaacgcaacaagaccctaaagaactatctgagtcttgcaaaatagcgccccaaaaaacctcttttaatccagtggtttttaaaaaaattaaaagaaaactcaacctctttattggaaatattttagctcggacagaagcgtataagaatgtcgtggcaaaatacgatgatctcacaggaaaatacgatgatctcaataagaatattgcggaaaaatacgatgatctcacaggaaaatacgatgatctcaataagaatattgcggaaaaatacgatgatctcatgggaaaatacgaagccttattggcaaaagaaacaaacatcaaagagactttttgggaatctcgcgctgataatgaaaaggaagcactatttttagagcatttttatctcactagcgtgtatgtggccactacagcaggctattatctcacgccaaaaggcgctaaaacttttatagaagccacggagcgttttaaaatcatagagccggtggatatgtttatgaacaaccccacttaccatgatgtggctaattttacctatttgccttgccctgtttctttaaacaagcatgctttcaatagcaccattcaaaatgcaaaaaaacctgacatttcattaaagccccctagaaaatcctattttgataatcttttttatcataaattcaacgctcaaaagtgcttaaaagcctttaataaatacagcaaacgatacgctcctttaaaaacccctaaagaggtttaaaaagagcgggctttatgttagaataattctgttttattattcaaaggagattgcaatgaatttagaccaattagaagtgagccatgacgctgattctttgtgcgtggtgattgaaatatccaagcattctaatatcaagtatgaattggataaagaaagcggggctttaatggtggatagggtgctttatggggcgcaaaattaccccgcaaattacggctttgtgcctaacactttaggatctgatggcgaccctgtagatgcgcttgttttaagcgatgtggcttttcaagccggaagcgtagtgaaagcgcgcttggttggggtgttgaacatggaagatgaaagcggaatggatgaaaaattactcgctctacccatagacaagattgatcccacgcattcctatgtcaaagatattgatgatttatccaaacacactttagataaaatcaagcatttttttgaaacttacaaggatttagagcctaataaatgggtgaaagtcaaggggtttgaaaacaaagagagcgcgattaaggttttagaaaaagcgataaaagcctatcaaggctaaagatttaaggggtttggctcaattaagcgataaaaacccttttttaacgctcacaaacaatataaaagtcttttgtcttgttgggtgttggtgtaaaatagggtagtttaaagcggatttttgcattccccataaaaagcgccaaaagctacaatttaacgatcttaaccccactgccacctaaattaatgggagcgtcgctaaagctcaccactttagggtggttttttaaaaattctttcacaaacttttctaaaatcccgctccctttgccatggcaaataagcacttcttcaaagccccctaaaagcgcatcatttaaaaaagcgtctagtaaatccagggcttcttcgctgcgttgcccccttaaatcaaggcgtaagctcgcttctttaggtttaggaacgatggttttagggggtttgaatttgtttttagggggtttttggatttgtttcaaccaactcccatgcgctttcaagcgcatgccaagctcggtttctaccaggtaatagcccttgtctaaaatttgtataaccagcacgctttcatttttataacgcgctttttcgttaatttgaaagcttgttatgatttgtgggatctcttggtctgttttatgcttgtttaaaatctcgctcgctttatggatttctttatgcatggagctggtatcttttgaagcgacttcgctttttaagatgtttaaggcttgttggtaggatttttccaattccaattttttatggtgaaagatttctttttgtttttccatttctaaaagccatgcgttttttaaatcttcttgctcttttaaagcattctctaaatgttcatttttttgtttcaattccctttctagcgtgctggaattttcaatcaaaacgttcaatttttccttatcttcgccatagaaggctttcgctttttcaatcaaaaaaggcggcacgccatagcgcaaagcggtttcaaacgcatagcttttgccaataaccccttttaaaaaagtgtaagtgggccgttctttttcctcgtcataaagagcggccagtaattccacttccttgttttctgccattaacacgctcaggcgtttgtggtgcgtggtgataacgatttggttgttttgcttaagcaatttttctaacagggttttatacaaactgctcgcttcatcagcgtcagtccctagctcaatttcatcaacgcctaagagcatgttttctttggataaaagagcgctaaattgcttcattctgcctgcaaaagtagagatattgttcgcgctgttttgggggtcattaataatggcgtggatttctctaaaataggggatagtagaatgatgggcgttgattttcataggaatgagatgcttgctcaaaaaagctgcgcttaaaagcgattttaagagcatggttttcccgcccgcattcacgccggtaacagcgagcatggatttttcaaacttcaaatttaagggctttggctcttttaaaatggggtgcgaaaagttttctaaaatcatttttttttgcgtaaagcttggcatgacaaattctaaattgtaggctttagcgaaattaagccgtgcttgcaagctgtctaaaaaatcaaattctttaaaaaggaattttaaaaataaaaggtgtttttgcaagctacggcttagagtttggcacatttcaacgatacagcaatctatttcattaccaatttgcgcgattttttgggcgattttttgcgcgctttcaggcaaaagatagaaataaccattagcactcctttctagcacaacgcctttgatcgcgctagaaaacccgctttttaataaaaggcattcataaccatgcttaaggtggctttgcgtatccactaaataaggggcaagctctttagagtgggcgtaatggtgaatgattttagtgctctcttttttaaggcggttcaagctttcattcaaagcgtctagggtagcgttcgccccttgtttgatttgcccttcatcatccaataaaaggatcaaatcattaaaaaaagggggtaaaataatggcgttaaggcgttcatgaaattttaaatgcgtgaaaggtttaaaggcgttttgtaaaacgacaatgtagcgcaatcgtttgacaatctcatagatttcatctaaatggagcgtccctaatttggtgagtttgacaacaataagatcgctttctttcacgcttttgggggcaggcaaaccgatcgcatccacttcatttaaataagtgaaagcctgtttgagatcgttttctaaagcaatagaacctctttcttttgcgaaaaaggttttaaaaagagcgataaactcttttaaatctaggctttcttctaggggtttgggtagggtattattattattcatcattaaggttggattaagggatctttttgaagcgtctgacaagaatccaaatccacaagaacatctttcataggggtttgttttttgcctaaaaagctcaaagtcccgctcactaaattaaaggtttggttattgactttgatgcctttacacaacaaggtttccccccttaaaaacgctctttgcaaagcgatttcttgttggttttgttggttttgtttataagtataaacgctgatgctcgctcctataatccctacgattaaaaaagctaaaatcttttgtttggggctagctaaaccaaaatcccttaaaactaaaaacaataaaattagcgttaaaaataaaacaaccgctacgcccattacatttcgcctctcaactgataggtaatatcccccgctccaaagcctatcacaaagcctttttcaatcgtttctaccacattatcattgactaacagctctaaaaaatccccctttttacgcaccctgtctataaaggtggggttataatgcttaaaatgggctttcaaatcaatgtctcttttaacttcactcgcgctataaacgggtaaaatgatcaacctgtcgcaatgctctaaaaaacattttttaaattcttctaaattgtccattaagcgagagtatttgtgcgcttgccagatcactataattttttcttgcgtattcaataaattggcataaatcctagcgctttttaaagtggcgccaatttcagtagggtggtgggcgtaatcatcaatgagaatgagattgtttttttgcaaaatatcaaagcgttttttaatgcctttaaaattcaataaattatttctaatttcttctaaatttaattcatctaaagcgcttaaaatcgccaaactcgcattcgtggcgttatgttcgcctaacccccacaccaaaaaagcccccaaatttttcaattcaaacgaagtgtaaggctctccgtcttttaaaatgtattggatattataaatgtcttttttttctaaaacaatggcgtctttagaatagttttttaaaaaaggatcttctttatagatcactcttttttgagcatggtctaaaaaatatttataagcgaagaaaaagcgttctaaatcgtggtcataatgctccaaatgttctggctccgtgttaggcacaatcgcgcaaaaagggttggaaaataaaaaacttgaatcgctttcatcggcttcaaaaaccaaactcatatccgcgctctctcgcacattggaatcaaactctttagaatgcgccccaataatcgctccaaaagcggggcaaatcgcgctcaacatggccgtgatactgctctttccatgagccccacacacgctaaaaacgcgcttgtctttaaggatagaatacaaagcgtctttacgagacaaaatagggatttctaattccttagccctttgtatttcggtattgtcttctttgataatggctgaatggatgatgacatcttgatggttgatcgcttttggatcatgcgggatattaatttctacgcctaaagctttcaaatacttaacgctagggcttatggcaatatcagatccgctgatcttagccccttgcgctttaaggtatttggctaagcctgaaatgccaatcccccctataccgatgaaatggatcttgcaatcttgcaggtttttgagtaaaacttttggggtttcaagcataattttctcggtaagcttctatgatttctaaaggcttttctaaaagagaagtgtcatagacaagggctaaacgcacatagtcagcaccgatatgattacgccctaaatacaaagctggtaaggtggtgatgccttcgttttgataaagcgttttagcaaaattttcgccatctttaacgggcagatacgcataaaaactataaggataaatgagcgtttctttaaagatttttcgcgctagtttcaaattattcgcataaatattgcggaaaaattctgcatgcctatcatctagccaagccacttcactagccttttggatcgcattagcgctcgtatagcctaaataggtgcgaaacgctttgtatttttctaaaaggctactatccccagcgataaaaccactccttagccctggagcgctagatcgtttggagagcgaatggataaccaaaacatttttaaacgctccattatcagccagcatgcaagcttctaaaagcgaagaaggaggcgtgttttcataaatttcactataacattcatcattaattaaaataaaatcatgctttaaagcgagtttgacccaagcgatcagctcttctaaagaaagggttcttccggtggggttgttaggggaatttaaaatcactaaatccacttcttgcaactctttttcattcaagcttggagtgaaatcattttctttaactaaaggcattaaaaggcttttagccctagcgaattgggctgatccttcatagatttgataaaaagggttagggtaggcgatagtggggtttggataatcaaataaaacaaaactagggaaattgaataacacttccctagatcctagcgtggagactaactcgttttctttcaattctatcttaaaacggcgtttaaaaaaacccctttgagcctctctcaaactctcttcaaacgcgcttttagggtagatattgagcgaatgggtgtggcttttaagagcgtcttgaatgaatttgggcgtttcaaatcgcggctcgccgatgcctaaatctaaccccttttttttaggggtgatctctttaaacaaggctcttaatcgttcaaaaggatatggctcaaaagtcatagggctactttaatttaaaatggaatagttgatcttacctaaaatttaagcgtttatcattgaaagcgttaaaaaagagcgaaagagagcataaaagaaagggcat

SEQ ID NO: 31 - DNA, 13440 bp, Helicobacter pylori
aaatgaatttgacactatacctaaattagcctttaaaaagactgattttaaggtcaatttttaaatggttcgtttaagaactactttttttgaggcatagaacttttaaagcctttcattctatcaatagcgtctctgtatttggcgatattttcttttgtaagttctgttacagcttttttcatgacaaccgcatacattctgtttaaaatcttgtgtatcgcgtcttctctattcttatccaaattttcatggataacgctttttgaagaattaaaccctcctgaagcgttattagtagaggtgtatgtgtatgttattgcctgaaaagttcctacttctacagcaaaatcatggacgacacgattgctttctggttcataaaaattaaaccatacagagcctgagctttgatccactagcgtgtctaaattgggactattgggatcttttaaattcattttcaaatcttctaagattcctacccaccctttcaaatccaaaacggaaaaaatctttttcttatcttgcacattcaaagctttttcatcttgaaaacgcaacacttgatagcctcttttttcaaaaatagtttggatttgattaattaaagcgtcttgaaacttatcaatatagggttttagattatcgctcacttgaatgcgtggcattaaaatacctacaacatgatggttttgtggggcttgaacaatatgcaccgggtaattaaaatctagtggcgtaacatgttcagaacttgttgtcattctttcatgagtttgaactggttgttggtttttggcgtcatttggtttttttgtctcagcacttggattcatcgcgcaaccgatcaacacgcttgaaagccccaaagcaaccaacattttagaataaaccctaacttttttaaagataaacgaacaccccataaaagactcctaaaataaaaattgaaaccgtaattatactatttttaagcaaatcaatttgcgctacaattttccttttctaatttcaagcatggcgattttaccacaagggattttatgctctattctttattatatggctattttaatatcaatcttttccagtatttgacctttagagcagggttagggtttttcatagccttttttctcacgctttttttaatgcctaaattcattctatgggccaaggctaaaaaggctaaccagcccatttctagcttcgtgccaagccaccagaataaaaaggatacccctacgatggggggcattgtgtttgtttttgcaaccattgttgcgagcgtgttgtgcgcgtctttgagcaatctttatgtgttgttagggataatcgtgttagtgggctttagttttgtgggttttagagacgattacactaaaatcaaccagcaaaataacgccgggatgagtgcgaaaatgaaatttggcatgctgtttatcctttcgcttatagtgtctgttttattgagccttaaggggttggacacttttttatacgcgccgtttttgaaaaaccccttgtttgaaatgcccacgatgttagcggttggtttttgggtgttggtttttttatccacgagcaatgcggtgaatttaaccgacgggttagacggattagcgagtgtgcctagcattttcaccctcttaagcctttctatctttgtgtatgtggcagggaatgcggaattttctaaatacttgctctatcctaaagtcatagatgtgggggaattgtttgtgatttcgctagcattagtgggatcgctctttggctttttgtggtataactgcaacccggcaagcgtgtttatgggcgatagcgggagtttggcaataggagggtttatcgcttataacgctattgtttcgcataatgaaatcttgctcgttttaatggggtctatttttgtaatagaaactctgtctgtgatcttgcaagtagggagctataaaacccgtaaaaaacgcctttttttaatggcacccatccatcatcattttgaacaaaagggttgggcagaaaataaggtgatcgtgcgtttttggatcatttctatgctgagtaatttagtcgctcttttgagcttgaaggtgtgttaaaatgaaaatttctttattggggcatggaaaaaccactctagccctagggcgtttttttaaaaaaaaccataatgaagtcaaattttttgatgataaattccctgcattttttaaggatagcgagggttttctttgctaccctagtaaggattttaaccctaatgattcccaactagaaatcgtcagccctggcattagtttcacgcaccctttagtcatgaaagccaagcatttaatgagcgaatacgattatattgatagtttgtttgatcattctttcacgcctacgatgataagtattagcggcactaacgggaaaaccaccacgaccgaaatgctcaccacacttttagaagattttaaggctgtgagtggggggaatatcggcacgcccttgattgaattgtttgaaaaacgatcgcccttgtgggtgctagaaacaagctccttttctttgcattacactaataaggcttaccctttaatctacttgctcatcaatgtggaagccgatcatttgacttggcattgcaattttgaaaattatttgaacgctaaactcaaggttttaacattgatgcctaaaacttcgctcgctatcctccctttaaaattcaaagaacaccctattgttcaaaactcgcaagcgcaaaaaatcttttttgacaaaagcgaagaggttttagagtgtttaaaaatcccttctaacgcccttttttttaagggagcgtttttattagacgcggctttagcccttttagtttatgagcaatttttaaaaataaagaatttaaaatggcaagattatagagaaaacgcccttaaaagactgaacgcttttaaaatcggctcgcataaaatggaagaatttagggataaacaagggcgtttgtgggtagatgacagcaaagccacgaatattgatgccaccttacaagccctaaaaacctttaaaaaccaaaaaatccatttgattttagggggcgatattaaaggggtcaatttaacccccctttttgaagagtttaaaaactataaaataagcctttatgccataggatcaagcgcttctatcatacaagccttagcgttagaatttaatgtttcttgtcaggtttgtttgaagttagaaaaagcggttcaagaaattaaaagcgttttattacaaaatgaagtcgctttgctttcacctagcgcggccagtttggatcaattttcttcgtataaagaaaggggtgaaaaattcaaagcgtttgttttaaaagattaaagcgcatgcgccacgacttctaattgtgagattttttgaaaaatttcgttccgttccgcttcgtttgaaacttccatagaaacattaaagctataaaatttagcgtttttagaagtgttttttaattccaatttaaaggggcgttggtaggtttctaaaagctcttttaacacgcttgtatcgttagtggtcataatcaccctataatcccaaacgcaagggtaaataatggtgggtttttctaaatcagacggcactaagaagctccttaaacaatttaggaatggcaatagggctgtatgtagagcggttgacaaagccaaacttgatttctgaagcaaagactttgaaaggcttcataggctctaaagaagcgttttggatgcaataaatttcttgaaaaagcaccacaaaaacctttcttaattctttaatttgcgttcttatttctaagacttgtcccaaactcgcaggggtgaaaaaatccgctttgatagagcggatgacaaacacgccttcttcattttcgggcaagacattttgtttaaaaaaaaactcgctcctagccctttcgcaatatttcaaataattcgcatgatagaccacgccttcagagtcggtatcttcgtaatataccctacagcgcattaattccccttacttaaataatgaaattttcttaaaattatacaatatgtaacttaactatagtataatctaggggcgttgctttataatttttaggtacttttgaaagtgggttttttcttaaatcttaagatctttagggatttcaaaaaactaatacagcaatagttgggcgattaaggacatagctccttaattttaatcattgacaaggagtttggtagttaggatatgggtaatcatttttctaaattaggatttgttttagcggctttagggagcgcgataggtttagggcatatctggcgcttcccctatatgactggggtgagtggtgggggtgcttttgttttattgtttttatttttatccttaagcgttggtgcggcgatgtttatcgctgaaatgctattaggacaaagcacgcaaaaaaatgtaacagaagcttttaaagagcttgacattaaccctaaaaaacgctggaaatacgcagggatcatgcttatttctggacctttaatactgactttttatggcactattttaggttgggtgctttattatttggtgagtattagttttaatttgcctagcagtatccaagaatctgaacaaatttttactcaaactttgcagtctatagggttacaatccatagggctttttagcgttttattcataaccggatggattgtttctagggggattaaagaaggcattgaaaaactcaatttggttttaatgcccttactctttgccactttttttggtttgcttttttatgcgatgagcatggattctttttctaaagctttccatttcatgtttgatttcaagccaaaagatttgacctctcaagtgttcacttattccttggggcaggttttcttttctctaagtatcggtttagggatcaatatcacttatgctgccgttacggataaaacgcagaatttgcttaaaagcacgatttgggtggttttatcagggattttaatttctcttgtggcagggcttatgattttcacttttgtgtttgaatatggggctaatgtctcacaaggcacagggttaatcttcacttctttaccggtggtttttggccaaatgggagcgataggcgttcttgtttcaattcttttcttgctcgcgctcgcttttgctggcatcacttctacggtggctttattagagccaagcgtgatgtatcttaccgaaaagtatcaatactctcgttttaaggttacttggggtcttgtagcgttaatctttgtggtaggcgtggtgttgattttctcgctccataaggattataaagactatctcactttctttgaaaaaagtctttttgattggttggattttgcatcaagcaccattatcatgcctttaggcgggatggcaacctttatttttatgggctgggttttgaaaaaagaaaaattgcgtcttttgagcgcgcactttttaggccctaaattgtttgcaacttggtatttcttgcttaaatacatcacccctttaattgtgttttccatttggttgagcaagatttattaaaatatttggcatgggaaaattttctaaattaggctttattttagccactttgggtagctctatcggtttagggcatatttggcgctttccttatatggtaggtcataatggggggagcgcgtttgtgcttttatacctagcactaaccttgagtttaggcattgctatgcttttagtggaaatgctgattggaaatttgggtaaaaaagacgttgtttccaattatcaaatcttagatcctaaaaggaaaaaatattaccctttcacttctttttttattttaggcggccctctcattctatctttttatgcggtggtgttaggctgggtgctttactatctttttgtagtaacttttgatttgcctaaagatttagagcaggctaaaatgcaattcagcatgcttcaaaatggcagtttgatctggcctgttattggctttagcgcatgcttgttgccgacaatatggtttgtttctagggggattgaaaaggggattgaaaaattaaatgtcgtgctgatgcccttattgtttgtgattttcatagggcttttaatctatgcgatgactttagaaagcatgcctaaagctttgcgttttttatttaattttgagattcaaaagattgattttaaggttgtgatggacgctttagggcagatgtttttttctttgagtttaggggtaggcacgatcattacttattcggcttttacgcctaaaaaagaaaacctactcaaaagctctctgtttattgttttaccgggtattttaatttctttgattgccggggtgatgatttttacctttgtgtttgaataccatgcagacgtgtctcaagggccagggcttgtttttatttccttacctttaactttcgctaaaatgggaatcagtgggcagatcgtttcgctctttttctttatggcgcttgtttttgccgggatcacttccacggtttctttaatagagcctttagcgctttatctcatcaatcgttttaatttctcacgccttaaggcgtcgctatggataggggttgttgtgtatgttttaggcgttttagtcattctttccatgaatgaacgatacgctaagtttttgagctttgctcataagagcgtgtttgggtggctggatttcatcacttcttcatttttaatgcctttgggaggcttgttttcagtcttgtttataggatggattttaaataaaaagcgctcttttttagccacgaagcatttctttagtgcaaacgcttttaaagcgtggcattttagcgttcgttttatcgcgcctgtagtgattttagcgattttcatcttgcaatttaagtgaaataaggatgcttgatgaaaagcattttgctctttatgatttttgtagtttgtcagttagaaggcaaaaaattttcacaagataattttaaggtggattataactactatttgcgcaaacaggatttgcacatcattaaaacgcaaaacgatttgtccaatgcctggtatctccctccacaaaaagcccccaaagaacattcttgggtggattttgctaaaaaatatttaaacatgatggattatctaggcacttattttttgcctttttatcatagtttcacccccatttttcaatggtaccaccctaatatcaacccctaccaacgcaatgagtttaagttccaaatcagttttagagtgcctgtatttaggcatattctttggactaaaggcacgctttatctggcttatacccaaactaactggtttcaaatttataatgaccctcaatccgcccccatgcgaatgatcaatttcatgcctgaactcatctatgtttatcctattaattttaaaccttttgggggtaaaatagggaatttttctgaaatttggataggttggcagcacatttctaatggtgtggggggtgcgcaatgttaccagccttttaataaagaaggtaatcctgaaaaccagtttccaggacaacctgtaatcgttaaagattataacgggcaaaaagatgtgcgctggggggggtgtcgttcggtgagcgcgggcaacgccctgtgtttcgttttggtgtgggaaaagggaggcctaaaaatcatggtcgcttattggccctatgtcccttatgatcaatccaaccctcaattgattgattacatggggtatggtaacgctaaaattgattacaggagagggcgccaccattttgaattgcaactttatgatattttcacgcaatactggcgttatgatcgctggcatggagctttccgcttaggctatacctaccgcattaacccttttgtggggatttatgcgcagtggtttaacggctatggcgatggcttgtatgaatacgatgttttttccaatcgtataggggtaggaatacgcttgaacccttaaaaaagcgttcttttatgctataattaagaccaaaaattcaaggggattattttagctatgaaaatcagtgttagtaaaaacgatttagaaaacactttgcgctacttgcaagcttttttggataaaaaggacgcttcctctatcgcttcacacatccatttagaagtcattaaagaaaagctctttttaaaagccagcgattcagatattggactaaaaagctatatttctacgcaatctaccgataaagagggcgtaggcacgatcaacgggaagaagtttttagatattatctcatgtttgaaagactctaatattgttttagagactaaagatgacagcttggtgatcaaacaaaataaaagctctttcaaactccccatgtttgacgctgatgagttccctgaattccctgttattgatccaaaagtgagtttagaaatcaatgccccctttttggtggatgcgtttaaaaagatcgctcctgtgattgagcaaactagccataaaagggaattagccggtgttttaatgcaattcaatcaaaaacaccaaaccctttcagtggtaggcacggataccaagcggctctcttacacgcagttagaaaaaatctctatccattccaccgaagaagacatctcttgcattttgcctaaaagggctttattggaaatccttaaacttttttatgaaaatttcagttttaaaagcgacggcatgttagcggtggttgaaaacgaaacgcacgcttttttcaccaagctcattgatgggaattaccctgattatcaaaaaatcctccctaaagaatacacttcttctttcactttaggcaaggaagaatttaaagagggcattaagttgtgcagttctttaagctccaccattaagctcactttagaaaaaaacaacgctttgtttgaatctttggattctgagcatagcgaaaccgccaaaacctctgttgagattgaaaaaggtttggatattgaaaaagcctttcatttgggcgtgaacgcaaaatttttccttgaagccttaaacgctttagggacaacgcaatttgttttaaaatgcaatgagccttcttcgccttttttgattcaagaacctcttgatgaaaagcaaagccacttgaacgctaaaatttccactttgatgatgccaatcacactataaaggccgatttgaatgcaaaattaccagagccatagtattaaggttttaaaaggcttagagggggttaggaaacgccctggaatgtatattggcgataccaatgtgggtgggttgcaccacatggtgtatgaagtcgtggataacgctgtagatgagagcatggcgggtttttgcgatacgatcaatatcactttgactgaggaggggtcatgcattgtagaagataacgggcgaggcattcctgtagacattcaccccacggaaaaaatccccgcttgcaccgtggttttaacgattttgcatgcagggggcaagtttgataatgacacttataaagtttcaggcggtttgcatggcgtgggcgtttcggttgtgaacgctttgagcaaacgcttgatcatgaccattaaaaaagagggtcaaatctatcgccaagagtttgaaaagggtattcccattagcgagcttgaaatcattggcaagactaaaagcgctaaagaaagtggcacgactattgaatttttccctgatgaaagcgtgatggaagtcgttgaatttcaagcgggtattttacaaaagcgctttaaagaaatggcgtatcttaacgatggcttaaaaatttctttcaaagaagaaaaaacccaactgcaagaaacttatttctataaagacggcttgaaacaattcgtgaaagacagcgctaaaaaagaattgctcacccccattattgcgtttaaaagcatggatgaagaaacgcgcacttctatagaggtcgctttagcgtatgctgacgattacaatgaaaacaccttaagctttgtgaataacattaaaacttctgagggtggcacgcatgaggcgggctttaaaatgggcttgtctaaagcgattttacaatacattgacaataacattaaaactaaagagtcgcgccccatctctgaagacattaaagagggtctgatcgctgttgtgagtttgaaaatgagcgagcctttgtttgaagggcagactaaatccaaactcggcagctcatatgcgcgcgcgttggtttcaaaattagtctatgacaaaatccaccaatttttagaggaaaaccctaacgaagctaaaatcatcgccaataaagccctactagccgcaaaagccagagaagccagcaagaaagccagagagcttacaaggaaaaaagacaatttgagtgtcggcactttgcctggaaaattagccgattgccagagcaaagacccgcttgagagtgaaatctttttagtggagggcgatagcgcgggcgggagcgctaaacaagggcgcgatagggtttttcaagcgattttacctctaaaaggtaagattttaaatgtggaaaaaagccatttgtcaaagatcctaaaatcagaagaaattaaaaacatgatcacggcttttgggtgcggcattcaagagagctttgatatagaaagattgcgctatcataaaatcattatcatgaccgatgctgatgtggatgggagccatatccaaaccttgctgatgacttttttctatcgttatttacgcccgctgattgaacaagggcatgtttttatcgctcaagcccctctttataaatacaagaaaggcaagacagaaatttatcttaaagacagcgtcgctttggatcattttttaattgagcatggcatcaattcggtggatattgaagggattggaaagaacgatttgatgaatttgttaaaagtggcgcgccattaccgctatacgcttttggaattagaaaaacgctacaacttgctagaagttttacgctttttgattgagactaaggacgccttaagccttgatatgaaagttttagaaaaaagcattttagaaaaattagagggcttgaattatcagatcttacgctcttttgctactgaagaaagcttgcatttgcacgcgcaaacccctaagggcttggtggaatttaacctagatgacaacctttttaaagatgtgttgtttgaagaagcgcattacacttaccaaaagcttatggaatataatttggatttcctagaaaataaggatattttggcgtttttagaagaagtggaaaattacgctaaaaagggagcgaatatccagcgctataaggggttaggcgagatgaaccctaatgatttatgggaaacgaccatgcataaagaaaaccgcagtctcatcaaactcaaaattgaagatttagaaaaaaccgatgcggtcttttcgctttgcatgggtgatgaagtagagcctagaagagcctttatccaagcgcatgccaaagatgtgaagcaactagatgtgtaaggggttttgattagaacccccaagcatttaaccaagcaagagagcgtgaatttaggggcttactacacgcccccttatttagtggattgcgcttacaagcttttaaaaaagcatgttggtattgaaaactacacgcttttagacaccgcatgtggtaataaagagtttttaaagctccaccaccctaaaaaaataggagcggatattgaccctaagtgtgatgctttaataataaacgctctagccaatcctaaaagagaaaattatggcattagccaagatgaacctttaatcatcgtgggcaatcccccctataacgatagaacttcctttatcaaacaagatattaaaaataaagatttcatttttgagatagacaacgatttgaaatcccgagatttagggataagttttttaaaatcttttgcaattttaaagccggcgtttatttgcgtgctacaccctttatcttatctcatcaaagaagctaattttaagcaattaaagctatttaaggatcattacaggcttttagacgcttttgttgtttcttctaaatctttcactaaaagtaacgaatttcctattgtgatagctttatatgagcgagggcgaatggactatgcaggtattaggcgttttgtttttccaactgattgcgatacgacgctatgcttaaacgattttgactacatagccaattatgtggataaataccctaacgctaaaaaggttggggcatgcgtgggctatttttttcctatgcgagacattaacgctctcaaacgcaacaaaacttttttaaacgcgccaagcgaaaatgcggtgcgaatcagtcaagataaattgatttattaccaatatatccattattttaaggaaattgctcctaaaatcccttattattttggtaatttggatattatcattgatcattttgcttttttagaaattaaagacgcttttttaaaagataaaagagcgcgtttagaatattttaaaaaattgtttcaaggacacccttgtgagtttgattaaagttagtggtgataaaaaagtgattgaggtttctattcctttaacttccatttcaggcaaagcgcgtgtgaaaatcagacatgcctttagcgattatggtatttcaacagcgactagaaaaatcccttttagtttaaagcattatgtagagtggcagatcggttatgatgtccccattaaagataaagaaaaatttgaactcactactttaaaagatgaaaaatatcattttttaggggctaataataaagtaaaaactctttatgaattgagcgaaatgatttattacgctaagcgattgggtttaatcagtttagaaaatttagaaaatactttaaaatttttagaaaaacaaaaacaatttatagaagataattttatgattacaagagaaagatttagatcgcatcaatttggtggcatggattttgaactctcacgcatttcttatcctttgctcattcattcttttgatgataatgagttgagcgaaatagttattaaggaacaacaatatggctctaaaacccaagccatgctgtatttttgcttttctattttggagttaaaaaccgctacccccttattaaacagaaccgctatgcccaaagaacatgcccttttgattatccatgaaaccaacgctcttgtgtttttagaaatgcttaaaatttttggacttttaagccaagtgcaccataacgatgtgttaaagattttagaaaaaatacttcaaaattaactaacgatacgaattgttaaaaagagaatgaatatccaacgctacaagatctaggcgagataaacccgtttatgggaaataaccatgcatcaataaaaacgcgcttcataaagctataaaaacaaggctaggcttta

SEQ ID NO: 32 - DNA, 15810 bp, Helicobacter pylori
ctaaaacctaacgataaatataaaataaagataaaatcctagaattttaacataaaagattaagcctaactttaaaaatcaagccttcaaaaaccctagaaatacttttctataaaaccaagagctacaaaaagaagcgcccctaaaagcgcagaaaccggcacggttaccaaccaagcggtaacaatctttttcaaaatggagcgtttgatcacttcttctttatacacttttttaagcgactttttttctttctttttcaattccaaagcgatagcggtgttcttgctttttttcaagctctctagcatgagcgatttttctttcaaattggctttatcaaagcgctctaaaaagccttcaatttcttctaaatcttccccaaagtgcgccgctacaatgttgtctctgattctagcaaaacgccttctggattgctccctcaaacgctcccttaaaaagcccaccccaaacaccgcgcccaccacaatatgcgtagagcttaccggtaagcctaattgagaggctaaaagcacggtgatgaccgctgaaagcgcgatgcaaaaagcttgcattttgtctaattctgtgatttcagaccccaccgttttaatgagctttggcccatacaagctcaagcctaaagcgatcccagctgcccctactaccataatccacaacggcacagagtttaaagtactccccatagggctgctcgcatcttctaaagtttgactgattgcggctaaaggaccgatagcgttagctacatcattagccccatgcgcaaagcttaaaagcgcggcggcaaaaatcaaagggacattaaaaagctcattgacgctttcgtggctattttctaattgcggggctttttttaacacaaatcttttaaaaaggataaaaatcaaaagcgcaaggacacaaccgcaagcgagctggatttcaaaacccaccgcatagaggcgttttaaaaccttcacgatcaaataccagctaaaggctaagctcatcaacgccaccaaataaggcacgacctttaaagccgcgctctttttatcttctttataagcgatagtctttttaatgagcattaaaaaaaacatggctatcaaagcccccattaaaggcgagattacccaactagccacaatgccggataaaaaatgccaattgatagcagacattccagctgctgccattccagcccccataatccctcccactacggagtgcgaagtggaaacgggagcgcctattaaagtggctacatgcaaccataacgccccactcaaaaggctagccaacatgacattaatgaaaacatgcgcatcgttaataaattcaggcgaaacgatacggcccttaatcgtagaaaccacttcccccccagcaatgatcgctcctagcatttcacaaaccgcagcgatcaaaatcgccccacccatgctaatggctttagagcctacggcagggccgacattattagacacatcgttcgcgccaatattcatcgccatataccccccaatcacggccgcaaagatgagcaacaatcccttagaattagcctgcccaaaaatgagagcgagcaaagcggcgccaatgaggaacaaaagagcgagagcgatctttaaagtgtctttttggagttttttggaagctttttcaaactctttgatgtttctaatttccatatcgtcatcaaaaccttattctaatagtggctctattctatccaattagcccttgagccactcttaaaaagcgttgtttgataaaaatggctcattatatggtatcttaaagtaaaattttaaaaataaggtttttaaaaatgatagaatttagcgatgaagatttacaaaaaccggtgcgtattgtaatagaaaagatccgcccttacttgctcaaagatggcggtaatattgaagtgctaggggtgaaaagcatgaaaatttatgtggctttagagggagcgtgtaagacttgctctagcagtaaaatcactttaaaaaatgtcattgaaaggcagcttaaaatggacattcaccccaatttagaagtggtgtgtttagaaaacgctaaggagtttgataagctttaaggatgattaggcatgcaaaagtttgattatgaatttaaaaagcgagcgttgattaaagagggatttttagcgttcaagcaagcccattacgctgaagcgttgcgccttttttctgaagttttgtttttggataaagacaaccaaaaagccaaagtgggggcgttattaagcgacatcgctaaagatttccctaaagaagcccatagcttttatgaattgtatcaaagcctgatcgctatgcaaaaacgaagtttaaaaaaccaggctgaagagcagatcaccgctttgatcgcttcttttgatgagggattgaaccaaatggctgaaaagattgatgcgcaaatttctcaaaaaggcgaggaattgaatggcattttgtatgcggatttcaaacgcttgagtctggagcgcggctttaaggaagcgtttggggatttgatgttcagctctagggtgatttttgacaataaagaggatttttatgaatttttgaaagaattgaaccattatggctattacgaattagcggtaaattacattgaaaacatgcatgaagattcttttatttacgatgaatttttgcgttctcttttagaagacgctctcaaatccaataaggcttaaagaatgaagcttaaaaaaaccctgacttatcaacaccacgcctattcttttttaagcgataacacgaatgaagttttagaaaaccctaaagaaatcctttttgtcaaaacgcctttaaacgaaaaatacgcccctttaatcgcagaaaaaaacctggctattttggattttaacgagcttaaaaactactttgattttaagattaagattgtagggattacaggcactaatggtaaaacgaccacagcgagcttgatgtattccttgctcttagatttgaataaaaagaccgctcttttaggcacaagagggttttttatcgacgacaaacacatcaaagaaaagggcttgaccacgcccactcttttagagctttatagcgatttggaagaagcgattcgtttaaaatgcgaatacttcattatggaggtgagctcccatgcgattgtccaaaaacgcatcgctgggcttgatttcgctcttaaaattctcaccaatatcacaagcgatcatttagatttccatcaaaatatagaaaattacagggacgctaaaaacagcttttttaaagatgagggcttaaaagtcatcaacagagatgaaacaaacgccctttttaaccccattaacgcgcgcacttacgcactggataaaaaagcgcatttgaatgttcaagccttttcgctcaacccttccattagcgcgtctttatgctaccaacacgatttaagagatcccaatcttaaagaaaccgccctgatccattccccccttttagggcgttacaacctttataatattttagcgggcgttttaggggttaaattgctcactcaattgcctttagaaacgatcgcaccgttattggaaaacttttatggggttaaggggcgtttggaaattgtacattctaaacctttagtggtcgtggattttgcccacacaacagacggcatgcaacaagtttttgaaagctttaaaaatcaaaagatcaccgctctttttggggcagggggcgatagggataaaaccaagcgccctaaaatgggagcgatagcgagttgttacgcgcatcaaatcatcttaacttcagacaatcctagaagcgaaaacgaagaagacatcattaaggatattttaaaaggcatcaataattcttctaaagtcattgtagaaaaagaccgaaaaaaggccattttaaacgctttagaaaatttaaaagacgatgaggtgttgttgattttaggcaagggcgatgaaaacattcaaatctttaaagacaaaacgattttttttagcgaccaggaagtcgttaaagattattatctcaatttaaaacaaggataaacatgcaagaattcagtttgtggtgcgattttatagaaagggattttttagaaaacgattttttaaagctcatcaataagggggctatttgcggggcgacgagtaaccctagtttgttttgcgaagcgatcacaaaaagcgcgttttatcaagatgaaatcgctaaactcaaaggcaaaaaagctaaagaaatttatgaaactctggcactaaaggatattttacaagcctctagcgcgttaatgcctttgtatgaaaaagaccctaacaacggctacatcagcctagaaattgacccctttttagaagacgatgcgattaaaagcattgatgaagccaagcggttattcaaaacattaaaccgccccaatgtgatgattaaagtcccggcgagtgaaagcgcttttgaagtcattagcgctctggctcaagcctctatccccattaatgtaactttagtcttttcgcctaaaattgccggtgaaatcgctcaaatcttagccaaagaagcacgaaaaagagcggtcattagcgtgtttgtctcacgatttgacaaagaaatagacccactagtgccacaaaatttgcaagctcaaagtgggatcatgaacgctaccgagtgttattatcaaatcaaccagcatgctaataagctaataagcaccctttttgcatccaccggcgttaaatctaattctttagctaaagattactacattaaagcgctgtgttttaaaaactctatcaacacagcccccctagacgccctaaacgcttatttgcttgacccaaacaccgagtgtcaaacccctttaaaaatcacagaaattgaagcgttcaaaaaagaattaaaaacgcacaatattgatttagaaaacaccgcccaaaaactccttaaagaaggcttgatagcgttcaaacaatcctttgaaaagcttttaagcagtttttgatttttaagggttttttggatagaataagcccttattttattttaaaggattgacatgttagaaggcgttattagagagagtattactaaagctaacgctaaagctttaaaaaaagatggctatctaatcgcaaacatttatggaaagggtgttgaaaacgtgaattgcgcgttcaaattaaaccctttcattaaataccttaaggaaaaaaagcatttgattttcccggtgaaattaggggataagacttttgaagtcgtggttcaagaataccaaaaaaaccccgttactaacgagcttatccatgtggatttactcgctgttactaagggcgtgaagtccaagtttaaagtccccgtcaaacaccaaggcactccagtgggcttgaaaaataaagggattttaatgctctctaaaaagcgtatcagcgtggaatgcgctccagagcatttgcccgatcactatttagtggatgtagcccctttagacgtgaatgagtctattttggtgcgcgatttagaaaaacacgaaaatgttaagattttagatcatgattctatcgctgtgatcggtgtgattaaagcgaagtgatttgaagttatgacgcttttagtgggtttaggcaaccctactttgcgttacgatcacaccagacacaacgctggttttgatattttagattcgctcgttagcgagctggatctttctttcattttttctcccaaacacaacgcttatttgtgcgtttataaggattttatcttactcaagccccaaacttacatgaatttaagcggtgagagcgttttaagcgctaaaaatttttacaaaactaaagagcttttaattgtccatgacgacttggatttacctttaggcgttgtgaagtttaaaaagggtggggggaatggggggcataatggcctaaaatccattgatgccttatgttctaattcttattaccgcttgagagtggggatttctaaagggatcaatatcactgagcatgtgctttcaaaattccacaacaacgaagagcctttaaaaaacgctgcgtttgaacatgccaaaaacgccttaaaattttttatagaaagccatgattttaacgctacgcaaaatcgtttcacgcttaaaaaacctttacaaatagaaagttaggggtttaaagtgcgtttgtttagatttgtggggtggtattatttcaaatactttttaatcgtgcttttagctttggaattgttttttgtaggcattgacagcctgaaatacgccgataaaatgcctgattctgcgaacatgatcattttatttttcacctatgatattttattcgctctcaattacaccttgcccatttccttgcttttagcgatggttttattttatatcaccttcattaaatccaaccaatacaccgccctgctctctattggattttccaaatgccagattttaagccctatttttttgattagcctgtttttcacggctgtttatgtggggttgaacgcgactccttttgtgtatatggaagaaaaaacgcaaaatttaatttataaagacaattctttgagcgtttcagagcatttgttagtgaaatacaacgatgattacgtgtattttgataagattaatcccttattgcaaaaagcccaaaatatcaaggtttttcgcctaaaagataaaactttagaatcttatgctgaagctaaagaagctttttttgaagacaaatattggattttacatgacactactatctatgagatgcccttgagttttgaactgggcgcgaacgctttaaacaccacgcatttagaaacctttaaaacgctcaaaaatttccgccctaaagttttagacaccatttatcaaaacaagcctgcggtttctatcacagacgctcttttatccttgcatgctttagtgcgccaaaacgcggacacgaaaaaagtgcgctcgtttttgtatgtgtttgcgattttgcccttttttgtgccgtttttaagcgttttaatcgcttatttttcgcccagtctcgcccgctatgaaaacctggctcttttagggctaaagtttatcattatcacgctcgttgtttgggggctattctttgctttagggaagttcagcatttcagggatactcattcctgaaataggcgttctatcgccctttttcgtatttctagctctcagtctttggtattttaaaaaacttaataagagattgtaagatttataaacttatagtcaagataactcaagctctcattagggggctaaattaaaaaacttgccatgcaacattaatttaatacttgtaaaatagcctaaaaaattattaaggttcttgatgagttctgtccaaatcctatctaatttcaattatcctattagcaaagtgattaacgaagggctaagaaattctttagacactcatattgcagttgcttttttaaaatacagtggggttgagattattcaagatgtcttgattaattttttagaaaagggggcagaatttgagattattgtaggacttgattttaaaacaaccgactcaaaatccatacgattttttctagacttaaataaaacttataaaaaattaaaattttactgctacggcgacaaagaaaataacaaaacagatattgtattccaccctaaaatttatatgtttgacaacggaaaagaaaaaacttccattataggtagcgctaatttaaccaaaggagggttggagaataattttgaagtcaataccatttttacagaaaaggaaccattatattactcacaactaaacgctatctacaattctataaaatatgcagatagtctgttcactcctaatgaagagtatttagaaagctatgatgaagtttttagcgccattattaaaaatgaacaaaaagtctcaaaagataaaagcattcaagaaaagattaaaaagattgaaaaacaagaaaaattgcttcctggaactatcccctctatcaaggcaatgatagtggaatttattttcgcttgtgagaaaaaaggcgttaaacaagtagcattacaagatatttatcaggcattagaagagagaataaaaaaagaagagtggggatacaaatacaaaagcgatacttttaaaaatagcattaggggcgaactcaaccaccatcaaaaagatagccattcaaaacattgctttggactctttgagagattgcaaaaaggtttttatgctctaacaccaaaagggcgttcgtataaaggacgctaaaggtatttatttcagacaatccagcctagtctaatttaaactctttacaaagctatctctcaatcaaaataaagaattgaaagaaaaatttgactccaatgaatatgtctttagcgatgaagagttagaatacgctaaaatatccctacaacagcataaggactcattgtgtggtaatggtagatttatcaaaaaagtagaaaacagcatagagttattgcaactcaatgacaacccaaaagcttgacaaatcaagctttcatatatatataagtataagctataagccttacccaaaaccctaccaaacttaaaaagtataaacataacgcaaatacatagaatactgacggcgtaaggtttgggttaagctgaaattggtttctgctccggtgatagtagtcgggttcccattctctagtgggccttgttttttcgctcttatagtagtagaacctttgaaaaagtaattagggagcgtggggattttgataccaaactcaatgccatggtgttcaaaaatattggttctaatgcccacattcactaaaaattggaaaatcgtgtgattcactttagcgtttaattttcctgtggtatagacgctgttagggttaatccccacattacaactcgccggcgtcgtgtctccgcatgtgatcgtgccatcagcgttagtcatgtaagcgtcagcgtccgtattgacgccataaacatacccgtccttaaaataccccacacgattattagtccaagtgttacccgcaaaattcacgcccacaaaaaacccggccgtggctttaggcttgtctataacgttaaaaagcatgtctgtgccaaaaccataagtatacatgtccgctttttgatcgctcaaataaaagggcgatatggcgttagcggccctagagttagagaaattggtatgcccgtaatcaaaaaagccataataacgcagcccaaaccacctttttttacccacaaaatgcttataccctgtcatcacgcctagcccatacatcggctggttacggccaggaatgtccttattggtgctaagcatggtgcgagaagtccaattgaccacgcaattagctttagtatagcctggcgttcctggagtccctgaagctggctgacagccaccggtctgcccatcagggactttgccatcatcattagccgaaacatcgccaaaaggcacttgaaacaactcgccgtttctataagcgttggtcttttgatcagccctacccacttccaagctaatccccacaaacgcgccattcttttcatgggcatttaaggggtttgtcagccataacgaactcaaaagagcgcctaaaattaccgagccttttttagaaatatctaaagattgagctatcaaaacagattccttacgattaaaatttttacaaaccattttgcaatcttgcattctatttttcttctttgtcataaaattgaccatcactctctagggtctccgcttaagtgttacttttttaattattttattatagctaattgcaatcttaaaagtcaaacgaaaatcgcccctaaaattcccataataatgggctacttgacaataaaatccttttatagtaaattaaaaactctttaattttcccatgaataaaggattttaaatggatgcgatttatccttatgtgttagttgttcatttgttgtgcgccattatttttattggctacttgttttttgatatggtaattttccccaatgtgaagaaaatgtttggcgaagagtttgccaataaagcgaatacaggaatcgctcaaagagcgatcaaaatcatgcctttgtgcgttttagggcttgttttaacagggggcatgatgcttagtcaatacatggggggcgataaaggctggtgtgaaaccccttttcaaaagatactcatgcttaaagtgatcttagcgttaagcatttttcttttggtgcttttttctttatcttgtaaatttttgggcaagaaaaaccctattggtaaatacactcatcacattgctctagcttttggctttttaatcgctattttggccaagacgatgtggtttgtttaagagcgtttcaacctcaaagaatttaaaaccactaagagcgagctaccactcatgctcaaactcgctattaaagggttgatgtatcctagcatagcgaccgggattaaaatagcgttataaatcaagcttaaaacaatgttttgcaacaccacttgatagactttttgagcgttatgaaacgctttttctagcaaactcaaatcctcttctaaaagcaaaatatcgcatgcacttttactcaaagcacttttttcaaaccccaaagaaacgctcgcttgtttcaaggccagcgcatcattattgccatcgcctaccatcgcacacacgcccttataagagctgatgatttgagccttatcttcaggggtcaaatgggcatgatacttagagatccctaattttttcgcgcactccttaaccgagctttcattatccccgcttaaaatttctaattccaagccttgattttgtaaagcctgaatgacttctttagcgttagctttcaaacgctcttctaaaatgaataacgcgcataaggtcttatttttcgcaaagcctaccatgatattagcgctctctttaacctttaaatcaacccccatagcgtttaaaaatttcaaactccccactagcaaggtttcgttttgatagctcgctttcaggccatgagcgaaaaactctatcttttccaaatcaacctcatcgccatctaatgttttaagaatcgcattatgggctaaatgctccctagtttttaaaaggctctttaaaagcctttcatcaaattcttcatgaatgattttttcttttaaaaggacttctttttgcgtgagggtgccggttttgtctataaagatttttttcactttagccagagtttctaaaaacaacgcttctttaaacacgatcaaagggtttttaaacacccctatcactaacgctatgggcgtagccagagcgaacgcgcaagggcagcttatgactagcacgctaatacacaccattaaagctttttcaaaattaccccccaaaccaaattgccacaataaaaagctcacaaaggctaaaaacaacaccgctttagaaaaaatatccgcgattttattcgcgctgctctcaattaagggcttttctaaaaaactcttttttaaagtttctagcaaactagaaaggcgtgagttttgaaaggtcgcgctcacttgatagctaaaaggcacgcccacgttcacataaccccctaaaattggatcattaacccccaattccaaaggcttaaactccccgctgatcaaagacgcatccacgctcgcgctatttaaaagcacgccatctaaagcgattttagccccgcttggcacccaaacaaccgagcctatcgccacatctttagggtgtttttctatctgcttgccgttttctacaacgatcacgctatggatttcatgcgattctagggccagacatttttcattcgcaaacagcctagcctttaattccaaaaacttagagccaaaaacaagcgttaaaatcgtgctgctcgcttcaaaataggtctcttgagacaccaacatcgcataaagggaataaacaaacgccgacaacgccccaaaagacacgctcaaatccatgcccaaaacgccattttttagcccataaaacgcccccttaatgaaaaaacgccccaccaccactagcaccaacaagcttaaaaagagcgatacgagatccaaattcctttgcatgagtttgtccataccgccgccataattcgcaccgccataactcgcgctaccatagcttgcgtatttggcaatggcaataaacatcaaattcatggtggcaaaaaaccccacgcttaaagtgagcaagtaggagcgttgctctttttgggcttttagggtgtaattttgcgcgttataaattttagccccatagcccaagctctcaatcttttgaataatctctttagggtttaaggacttgtcaaacacgatttgcaagtggtgggtggtgaaattcacgctcacttttttaaccccctttaaacgctctaaaaccttttgattgagccacaagcaagcgttacaatgcgttttttctagcaaaagattgagaataaaatcgcccttattgttttcttcaagggcttgttctaattctaaaatattcattgaatcttggggcgttacgggggctaaagtggaatcgtttaacttgtcataaaagctctctaaattcaaatctgttaataacgcatacaccctagcgcaccctgcgcagcaaaaatgcaattctttatgattaatagtctctttaaaaagatcgctttctttaaactccaactggcaatgcgaacatttcatttttaatcctcaatctaaaggcgctttgatagaataagtgttacaaatttgatagatgtttaaaacttctttggtgttgtcgctttggtttttggaattgtgcgtgattaaagggggcaaaacttttagagcgcttttggaattattcctagccgctccaagcatcaaatgggcgtttttgtctttgaaactttggacaaaccttaaagtttctagcgtgagtttaacgctttttaagctctctatgaccaagcaaagcgacaaggcttcatagcaaaaaataaaataccctttaggtttcaggcattttttcactttagccaccaaagaagcgaagtctaattcgctctggtgcctcgcatgccctttaatttgagatttaatagatcctaaagcataaaaaggagggttgcacacaatcgcatcatacaaaatcggagggttaaaatctaaaaaatcgctctcaaacacttgagcgttagggaatttaagggcgtttttttgggagcaaaacgccattttgctatccttttccactaaatgaacgctcgctagcgggttgtctctagcgcagagcaagcctagaaccccacaccctgagcctatgtctaaaatcgcgccgctatttttgataaaagggcgtgaaaaatcgtataaaaaaagcgaatcgctattgtaagaataagcgtttaagggctggtataatcttaagagttttctatccataaaagggcttcattttctaagatttgcgcatgcaacaaccgccctttaaaaggggtttttagagcgagcgtattaaacgcttcaccaatcatagacgcatgcgaatgcaaaagcaacgcatcaattttatccctcaaaccctcaaacaatccccaccccccttcaatgaaattaaaccctttctctaggggtaaatctttagggtcatgaaaagtattaaccaaacgattgggcgcaaaaaaaacttttgaatgggggctaattgagcgcttggataaaatagcgatattggggtttttattgtgataaaagctatcgcaaaagcgagcatctaataaggggttgtccgttcttatggttttcccagaaatgatgagagtgtcgcataccgctcgctggttgtgcgtgaaaatcacgcttttttgcccagtgatcttgccatgatgataatccccattcatccttaaagcgagtttgaacaaattaaaacgccccttttgttccattaccctaaaaggcaagagcaaatttttagccttgttttctaaattatgacaaattattgtttcaatgtgagctttttgtagcctttctaaacccccttttttggcttcgttttcttctgtggcaatgatcactcttttaggctttaagatttctaacaatccgctgcacgccggggttttgccataagaattgcatggctctagggtgattaaaaaaacgcagtctttaaaggcgttatcgtggcgcgtttttaaaaaatcgcttaaaattttagggtcttctaatttttctaaatcgctttttaaatgggggcgtaaaatctttaacgccgatttagcagccaagacttctgcatgcggggttttggcttttttatgggtttctaaactcaagatctcatggtttttatctagcaccatgcaggctacgcttgggttttctaaggctagggtttgatattcccacgccttattcaagcaaatttctaataaactttcataaagtctcatggtttaactagggaaaaaaggcaaaagcaaaaagcctttaatcgctaaagcgttaataatatcaacaaaaaacgctcccactaaaggcacgacgataaacgccacatgcgatggcccatagtggttggtgatggtttgcatattcaccatagccgttggggtcgctccaagcccaaaaccgcaatgccccgcgcacaacaccgccgcatcataatccttcccgcataccctaaaggttacaagcaccacataaaggatcataaccgccacttgaacgctcaaaataaccgctaaaggcacagcgagttttaacaattccaataaattcacgctcattaaagcgtaagctaaaaacaggctcaagctcacattccctataactgaaacctctctgtcaaacacgctatggattttaaaaaacgacaaagcgttccttaagataacccccacaaacaaacaccacacgaaagtcggtaaggtgaaacttttaggcatcaaatgcgataaaaaagtccccactaataaagctattgcaatgagagctaaagtttctacaaaactggatgcagtgattaggcgctgctctttaggggtttcaaaacctttagacaccacgccctctaaagtgtctttttctttagtgtctttaggttctagtttgtatttagaaatcaaatatttagcgacaggccctccaataatccccccgctcaccaagccaaaagtcgcgcacgccatgcccacttccaagctagagctaaaatgataaggtggttgggtgaaaaaattagcccatgccgcactagtgccatgcccacccactaaagcgatcgatccccctaaaagccccattaaaggattgacccctaaaaggctagcgatagaaatccccactgcattttggcacaccacaaaccccgctacagccagcaaaaaaaccgcaagcattttcccgcctttttgtaaagatttgaaatccgcgctcaaaccaatggtgatgaagaaagtcagcattaaaggatcttttaaagaagaatcaaactgcaagccaaaatgataaaattgacgcgctaacatgataaaaaaagcgactaaaaccccacccacaacaggctctggaatatcataatctcttaaaaacttgactttagaaatcacataacgccccaaaagcaacaccaaaaccatgcacactaaagtggcataaatgtctaatttaatttcttgcaagcctgtatccttattaatcaaatttatcttattataatataatagccccctaaaagaacgagattagttaga

SEQ ID NO: 33 - DNA, 4139 bp, Streptococcus pneumoniae
ggcctttttccatttcgtcgaaaatggcaacagcatcttctactgattgttaatgggattgctttctgtttgttggctcttgtggtgattatgagtcggacattaggaatttctgtgtaaaagtttttatgtaggaaccgacctctttctactagggaaagatgaatgcaatcgtgtccatctttttctttttatggtaaaatagaaaaataatatgatgaaaatccttgagggagtgaccgatatgtcaagtaaagccaatcatgcaaagacagttatttgcggaattatcaatgtaaccccagactccttttcggacggtggtcaattttttgctcttgagcaggcactccagcaggctcgtaaattgatagcagaaggagccagtatgctcgatatcggcggagaatcgactcggccgggcagtagctatgttgagatagaaatagaagaggaaatccagcgtgttgttccagtgatcaaagcgattcgcaaggaaagtgatgtcctcatctctattgatacttggaagagccaagtagcagaggctgctttggctgctggtgccgatctagtcaatgatatcactggtcttatgggtgatgagaaaatgcctcatgtggtagctgaagcgagagcgcaagtggtcatcatgtttaatccagttatggcgcgacctcagcaccctagctcgctcatcttccctcattttggttttggtcaagcttttacagaggaagagttagctgactttgaaacattgccaatcgaagaattgatggaggctttctttgaacgagcactagcgagagcggcagaagctggtattgcaccagaaaatatcctgttggatccaggaattggctttggtctgaccaagaaagaaaatctgcttcttttacgggacctggataaactacatcagaagggctatccaatctttctcggagtgtcgcgcaagcgatttgtcatcaatatcctagaggagaatggttttgaagtcaatcctgagacagagcttggtttccgcaatcgggacacggcttcggctcatgtaaccagtatcgctgcaagacagggtgtagaagtggtgcgcgtgcatgacgtagctagtcacaggatggcagttgaaattgcctctgccattcgtctggctgatgaagcggaaaatttagatttaaaacaatataaataagatgaaagaaattgaaaacaatcaatggattgctaactaccggacggatcaaccgcattttggcttggaacgaatggtggaactgttagctttgcgtggcaatccccatctcaaactcaaggtcctccatatcggaggaactaacggcaagggctcgactattgcttttttgaaaaagatgctagaaaagctagggctgagagttggcgtgtttagctcgccctatctcattcattacacagaccagattagcatcaatggggaatcgatctcagaagcgaggctagaagctctcatggcagactatcagtctttgctggagggagaagcggtcgccaatttacagggcacaaccgagtttgagattatcacagccctggcctatgactactttgcctcagagcaagtagatgtggccatcatggaagttggcatgggtggactttttgatagtaccaatgtctgtcagcccattttgacaggaattacaactattggcttggatcatgtggccttacttggtgacaccttggaggccatagcagagcagaaggcaggtattatcaaacaagggatgcccttggtaacagggcgtattgctccagaagccttggctgtgattgaccgcattgcggaagggaaagatgcgccgagacttgcctacgggacagattatcaggttcgtcatcaagaaagtgtggtgacaggggaagtctttgactatacaagtgctgtcagacaaggtcgcttccagactagcctgcttggtttgtaccaaatagagaatgctgggatggccatagctttacttgatactttttgtcaagaagatggtcgagagctagcaagcaatgactttcttggtcaagccttggaagaaacaagttggccagggcgtttggaaatcgtgtcaagagatcccttgatgattttggatggagcccataatccccatgctatcaaggccttgttggtaaccttgcaagaacgttttgcggattatcataaggaaatcctcttcacttgtatcaaaaccaaagccttggaggatatgttggacttgctgggagccatgccagataccgagcttactctaacacattttgcggatagtcgggcgacggatgaaagcgtgctgaaagaggcagctaagtctagaaatctcagctaccaagattggcatgattttctagagcagaatgtgacagataaaaaagaagagaaacaaacagttaggattgtcacaggttccttgtatttcttgagccaagtgagggtctatctgatggagaggaagaacgagaatggatacacaaaagattgaagcagctgtaaaaatgattatcgaggctgtaggagaggacgctaatcgcgagggtttgcaggaaacacctgctcgtgtagcccgtatgtatcaagagattttttcaggtcttggtcaaacagcagaggaacatttgtcaaaatcctttgaaattattgacgataatatggtggtagaaaaggatatctttttccataccatgtgtgaacaccacttcttgccattttatggtagagcgcacattgcctacattccagatggtcgtgtggcaggcttgtctaagctagcccgtacggttgaagtttattcgaaaaaaccacaaattcaagaacgtttgaatatcgaagtggccgatgccttgatggactatctaggtgctaaaggagcctttgttatcattgaggcggaacatatgtgtatgagtatgcgtggtgttagaaaaccaggcactgcaaccttgacgacagtagctcgtggtctatttgaaacagataaggacctccgcgaccaagcttatcgtttaatggggctataaaaagaatccgtttcaagcggatttttctagaaaggaatcattatggatcaactgcagattaaggatttggaaatgtttgcctatcatggtctttttcctagtgagaaagaattggggcagaaatttatcgtttcagccatcctatcctatgatatgaccaaggcagctacagacttggatttaacagcctctgtccattacggagaattgtgtcagcagtggacgacttggtttcaggaaacgagtgaagatttgattgaaacggtagcctataaactggtggaacgtacctttgagtcttatcctcttgtccaagaaatgaagttggaactgaaaaaaccttgggcaccggtgcatttgtcactagatacttgctcggtaaccattcatcgccgcaagcaacgagcctttatcgccctaggaagcaatatgggagataagcaagcaaacttgaagcaagccattgacaaactgcgagctcgtggcatccatattctcaaagagtccagtgtcttagcgacggagccttggggtggagtggagcaggatagctttgccaatcaagtggttgaggtggaaacctggctaccagcacaagacttgttagaaaccttgttagccattgagtcagagctgggacgggtgagagaagtgcattggggacctcgtttgattgatttggacttgctctttgtggaggaccagatcctttatacagacgacctcatattgcctcatccttacatagcggaacgcctttttgtccttgagtccttacaggaaattgcgcctcattttatccatccgatattaaaacaaccgatccgcaacttgtatgatgctttgaaaaaatagaaaaactctagttttcagttacttgcaactgaaggctagagtttttaaaataggtcattttcttctgggaggaggatagtttctctaccgtccatgtctaaaaccagtactcttgggggataacgagggtcgaaaggatggttaaagtcaaaatcaatggctgtagggaggtgttgacttgaaaagtggaaggtaatctttccttggttattaagcaattgaaactcgag

SEQ ID NO: 34 - DNA, 15870 bp, Streptococcus pneumoniae
ttttccataattttctactcaaattgtggtacaattaagagtaagattttaagttagaaatgagactgatttgtatgagaaaatttaacagccattcgattccgattcggcttaatttattgttttcaatcgtcattttactctttatgaccattattggtcgtttgttgtatatgcaggttttgaacaaggatttttacgaaaaaaagctagcctcagctagtcagaccaagattacaagcagttcagcccgtggggaaatttatgatgctagtggaaaacctttggtagaaaatacgttaaagcaggttgtttcctttacgcgtagcaataaaatgacggctacagacttaaaagaaacagctaaaaagttactgacttatgtgagcatcagttctccaaatttgacagaacgccagctggcggattactatttggctgatcctgaaatctataaaaaaacagtggaagctctcccaagtgagaaacgcttggattcagatggcaatcgtctatccgaatcagaactgtataacaatgcggtcgatagtgtccaaacaagtcaactaaactatacagaggatgaaaagaaagaaatctatctttttagtcagttaaatgctgttggaaactttgcgacaggaaccattgctacagatcctctaaatgattctcaggtggctgttattgcctctatttcaaaggagatgcctggcattagtatttctacttcttgggatagaaaggttttggaaacttccctttcttctatagttgggagtgtatccagtgaaaaagctggtctcccagcggaagaagcagaagcctatcttaaaaaaggctattctctaaatgatcgtgttggaacctcctatttggaaaagcaatatgaagagaccttacaagggaaacgctcggtaaaagaaatccatctggataaatatggcaatatggaaagtgtggatacaattgaggaaggtagtaagggaaacaatatcaagctgaccattgatttggccttccaagatagcgtggatgctttgctgaaaagttatttcaattccgagctaggaaatggtggagccaagtattctgagggtgtgtatgcagtcgcccttaaccccaaaacaggtgctgttttgtctatgtcaggactcaaacatgacctgaaaacgggagagttgactcctgattccttgggaacggtaaccaatgtctttgtcccaggttcggttgtcaaggctgcgaccatcagctctggctgggaaaatggagtcttatcaggaaaccagaccttgacagaccagtccattgtctttcaaggttcagctcccatcaattcttggtatactcaggcttacggttcattccctatcacagcagtccaagctctggagtattcatctaatgcctatatggtccaaacagctttaggtcttatggggcagacctaccaacctaatatgtttgtcggcaccagcaacctagagtctgctatggggaaattgcgttcaacctttggtgaatatggtttgggttctgcgaccgggattgacctaccagatgaatctactggatttgttcccaaagactatagctttgctaattacatcaccaatgcctttgggcagtttgataactatacgccgatgcagttggctcagtatgtagcaactattgcaaatgatggtgttcgtgtggctcctcgtattgttgaaggcatttatggaaataatgataagggaggcctaggcgacttgattcagcaactgcaaccgacagagatgaataaggtcaatatatccgactctgatatgagtattttgcaccaaggtttttatcaggttgctcatgggactagtggattgacaactggacgtgccttttcaaatggcgcagcggtatccattagtggaaaaacaggtactgccgaaagttatgttgagggtggtcaagaagctaacaatactaatgctgtggcctatgcaccatcagataatcctcaaatcgctgtagctgttgtcttccctcataacaccaaccttacaaatggtgtcggaccttccattgcgcgcgatattatcaacctctataaccaacatcatccaatgaattagaaaggaacatatgctttatccaacacctattgctaagttgattgacagttattctaagttaccaggtatcgggattaagacggctacgcgtctggccttttatacgattgggatgtctgctgatgatgtcaatgaatttgcaaaaaatctcctttctgctaagagagaattgacatattgttctatttgtggacgtttgacagacgacgatccttgttctatctgtactgatccgactcgtgaccagacaacaattttagttcttgaggatagtagagatgtggcagccatggaaaatatccaagaataccatggactctatcatgtccttcatggcctcatttctcctatgaatggtatcagtccggacgatatcaatctcaagagccttatgactcgtcttatggatagtgaagtttcagaagtgattgtggcgactaatgctacagcggatggtgaagcgacttccatgtatctttcacgtttgctcaagccggctggtatcaaggttacgcgtctagcacgaggtctcgctgtgggagcggacattgagtatgcggacgaagtgacactcttacgagcgattgaaaatcggacagagttgtaagtgtaggcaaatttacgaactccattcatttataaaaaatcaaagaggctgaaaatcgttcctatcggcctctttttgtatagtgtgatgagtaggatcaggttcaagttttaaaaaaccaagcaaatatgatatactaaagagcgagtattctagtagaattaggacaaataatatgaaacaaacgattattcttttatatggtggacggagtgcggaacgcgaagtctctgtcctttcagctgagagtgtcatgcgtgcggtcaattacgaccgtttcacagtcaagactttctttatcagtcagtcaggtgactttatcaaaacacaggaatttagtcatgctccggggcaagaagaccgtctcatgaccaatgaaaccattgattgggataagaaagttgcaccaagtgctatctacgaagaaggtgcagtggtctttccagtccttcacgggccaatgggagaagatggctctgttcaaggattcttggaagttttgaaaatgccttacgttggttgcaacattttgtcatcaagtcttgccatggataaaatcacgactaagcgtgttctggaatctgctggtattgcccaagttccttatgtggctatcgttgaaggcgatgatgtgactgctaaaatcgctgaagtggaagaaaaattggcttatccagtcttcactaagccgtcaaacatggggtctagtgtcggtatttctaagtctgaaaaccaagaagaactccgtcaagccttaaaacttgccttccgatatgacagccgtgtcttggttgagcaaggagtgaatgcccgtgaaattgaggttggcctcttgggtaactacgatgtcaagagcacgctacctggagaagttgtcaaggacgttgccttttatgactacgatgccaagtatattgataacaagattactatggatattcctgccaaaatcagtgatgatgtggtggctgtcatgcgtcaaaatgcagaaacagccttccgtgccattggtggccttggtctatctcgttgcgatttcttctatacagataagggagagatttttctcaacgagctcaataccatgccaggttttacccagtggtctatgtacccactactttgggacaatatggggatcagctacccagaactaatcgagcgtttggttgaccttgccaaggaaagttttgacaagcgcgaagcgcatttgatataaaatgaaagagagggtagaagccagaaccatcactgcacggtgactagagttctcggacttcagccctttttaaaggagtagaaatgaaattaacaatccatgaaattgcccaagttgttggagccaaaaatgatatcagtatctttgaggacacccagttagaaaaagctgagtttgatagtcgtttgattggaactggagatttatttgtgccacttaaaggtgcgcgtgatggccatgactttattgaaacagcctttgaaaatggtgcagcagtaaccttgtctgagaaagaggtctcaaatcatccttacattctagtagatgatgttttgacagcctttcaatccctagcatcctactatcttgaaaaaacgactgttgatgtctttgctgttacaggttcaaatggcaagacaacgactaaggatatgttggcgcatttactgtcaacaagatacaagacctacaaaacacaaggcaattacaataatgagattggccttccttacacagttctccacatgcctgaaggaacagaaaagttggtcttggagatggggcaggaccacttgggagatattcatctcttgtctgaattggctcgtccaaaaacagccatcgtgaccttggttggagaagctcatttggcctttttcaaagatcgttctgagattgctaaaggaaaaatgcaaattgcagacggaatggcttcaggttccttgcttttagcgccggctgaccctatcgtagaggactatttgccaactgataaaaaggtggttcgttttggtcaaggagcagagctggaaattactgacttggttgagcgcaaagatagtctgaccttcaaggccaatttcttagagcaagtccttgatttgccagtaactggcaagtataatgcgacaaatgctatgattgcatcctatgttgccttgcaagaaggagtttcagaggagcaaattcatcaggccttccaagatcttgaattgacgcgtaaccgtaccgaatggaagaaagcagccaatggagcagatatcctgtctgatgtatacaatgccaatccaactgctatgaagttgattttagagactttctctgccattccagccaatgaaggtggcaagaaaattgcggttttagcggacatgaaggaactgggtaaccagtcagttcaacttcataatcagatgattttgagcctttctccagatgtgcttgataccgtgattttctatggagaagacattgctgaattagcccaattggccagtcaaatgttcccaattggccacgtttactacttcaagaaaacagaagaccaagaccaatttgaagacctagtcaagcaggtcaaggaaagcctcagtgccaatgatcaaatcttgctcaagggctctaactctatgaacctagctatgttggtagaaagtttagaaaatgaaaccaagtgattttgttaagtatctgcaaagaatgattgcccttacagatactggcttaacctttacaaaagatccttttgaccgtgagcgctacgaggacttgcgaagtctgttatctgaaatgttgaatcagggatcagacctggatgcagaagaagtagcagaagtcttgaaaccaacttcagcttatgcgactcccttaatggacgtccgtgcttggattgttgaggatgagaagatttgtctggttaggggacaaggagagggtagttgggctttgccaggtggctttggtgaagtcggctattctccaactgaaaatattctcaaggaaattgaagaagaaaccggttttaaagccaaagttgaaagactgctagctgtttttgatatcaatcgtttccaactacagagcaaacaatatgcaaagtttgtttttgaatgtaagcttctcgatggacaattccaagaaaatcaagaaattgcagaccttcaattttttgccattgatcaactgccagtcttatctgaaaaacgcattaccaaggagcaaatagagattctttggcaggtttatcaaggtcagagggagcaatatcttgactaagaagatgattatcgtatttttaaatccatttttaacaactagcatggtataataatatgcaggaaaattttgaattatgaggaagactagatgaatttatgggatattttctttacgactcaggcaaccaagccgcccaaatttgaccttttttggtatgttagcctatttacgctcttagccttaaccttttatacagcccatcgctatcgtgaaaagaaggtttaccaacgatttttccaaatcttgcagactgttcagttaatccttctttatggttggtactgggtcaatcatatgccactgtcagaaagcctacccttttaccattgccgtatggctatgtttgtggtactcttgcttcctggtcaatccaaatataaacaatactttgcattattgggaacatttgggacattagcagcctttgtttatccagtgccagatgcttacccttttccacatatcaccattctatcctttatctttggtcatttagcactcttggggaactctctagtttatctattgagacagtataatgcgcgattgctggatgtgaagggaatttttctcatgacctttgccctaaatgccttgatttttgtggtcaatttggtgacaggtggcgattacggatttttgacaaaaccgccattggttggggatcacggtctagtagctaattatttacttgtttcaattgtgctggtagctactatcagtttgactaagaaaatcttagaattctttttagctcaagaagcagaaaaaatgattgtaaaggaagcttaacacagagctttcttttttgctcttagagagtttttacaatcagcttataaaataagaatttctgaatagacaaactcaaaaaatggctgggaaatttaggaaaaaagcaagcacgattaaattttttgtgttataatattttgtgaatagctatgcctatgtttagctatggaataatacgaagtgcgaaacttggaagatagagaggaagcgatgtaatggctagagaaggcttttttacaggtctagatattggaacaagctctgtcaaggtgcttgtggccgagcagagaaatggtgaattaaatgtaattggcgtgagtaatgccaaaagtaaaggtgtaaaggatggaattattgttgatattgatgcagcagcaactgctatcaagtcagccatttcccaagcggaagaaaaggcaggcatttcgattaaatcagtaaatgtcggcttgcctggtaatcttttgcaggtagaaccaactcaggggatgattccagtaacatctgatactaaggaaattacggatcaagatgttgaaaatgttgtcaaatcagctttgacaaagagtatgacacctgaccgtgaagtcattacctttattcctgaagaatttattgtggatggtttccaagggattcgtgacccacgtggcatgatgggggttcgccttgaaatgcgtggtttgctttatacaggacctcgtactatcttgcacaatttgcgtaagacggttgagcgtgcaggtgttcaggttgaaaatgttatcatttcaccactagcaatggttcagtctgttttgaacgaaggggaacgtgaatttggtgctacagtgattgatatgggggcaggtcaaacgactgtcgctacaatccgtaatcaagaactccagttcacacatattctccaagaaggtggagattatgtaactaaagatatctccaaggttttgaaaacctctcgcaaattagcggaaggcttgaaactgaattacggggaagcctatccgcctcttgcaagcaaagaaaccttccaagtagaggttattggagaagtagaagcagtcgaagtgacggaagcctacttgtcagaaattatttctgcacgaatcaagcacatccttgaacaaatcaagcaagaattagatagaaggcgtctattggacctccctggtggtattgtcttaatcggtgggaatgccattttaccaggtatggttgagcttgctcaggaagtctttggcgtccgtgtcaagctttatgttccaaatcaagttggtatccgtaatccagcctttgcgcatgtgattagtttatcagaatttgcgggtcaattaacagaagttaatcttttggctcagggagcgataaaaggtgagaatgacttaagtcatcagccaattagttttggtgggatgctgcaaaaaacagctcagtttgtacaatcaacgcctgttcaaccagctcctgctccagaagtagagccggtggcgcctacagaaccaatggcggatttccaacaagcttcacaaaataaaccgaaattagcagatcgtttccgtggcttgatcggaagcatgtttgacgaataaagaggaaaaataaattatgacattttcatttgatacagctgctgctcaaggggcagtgattaaagtaattggtgtcggtggaggtggtggcaatgccatcaaccgtatggtcgacgaaggtgttacaggcgtagaatttatcgcagcaaacacagatgtacaagcattgagtagtacaaaagctgagactgttattcagttgggacctaaattgactcgtggtttgggtgcaggaggtcaacctgaggttggtcgtaaagccgctgaagaaagcgaagaaacactgacggaagctattagtggtgccgatatggtcttcatcactgctggtatgggaggaggctctggaactggagctgctcctgttattgctcgtattgccaaagatttaggtgcgcttacagttggtgttgtaacacgtccctttggttttgaaggaagtaagcgtggacaatttgctgtagaaggaatcaatcaacttcgtgagcatgtagacactctattgattatctcaaacaacaatttgcttgaaattgttgataagaaaacaccgcttttggaggctcttagcgaagcggataacgttcttcgtcaaggtgttcaagggattaccgatttgattaccaatccaggattgattaaccttgactttgccgatgtgaaaacggtaatggcaaacaaagggaatgctcttatgggtattggtatcggtagtggagaagaacgtgtggtagaagcggcacgtaaggcaatctattcaccacttcttgaaacaactattgacggtgctgaggatgttatcgtcaacgttactggtggtcttgacttaaccttgattgaggcagaagaggcttcacaaattgtgaaccaggcagcaggtcaaggagtgaacatctggctcggtacttcaattgatgaaagtatgcgtgatgaaattcgtgtaacagttgttgcaacgggtgttcgtcaagaccgcgtagaaaaggttgtggctccacaagctagatctgctactaactaccgtgagacagtgaaaccagctcattcacatggctttgatcgtcattttgatatggcagaaacagctgaattgccaaaacaaaatccacgtcgtttggaaccaactcaggcatctgcttttggtgattgggatcttcgccgtgaatcgattgttcgtacaacagattcagtcgtttctccagtcgagcgctttgaagccccaatttcacaagatgaagatgaattggatacacctccatttttcaaaaatcgttaagtaaatgaatgtaaaagaaaatacagaacttgtttttcgagaagttgcagaggctagtctgagtgctcatcgagagagtggttcggtctctgtcattgcagttaccaagtatgtagatgtaccgacagcggaagccttgcttccgctaggtgttcatcatatcggtgaaaatcgtgtagataagtttctggaaaaatatgaagctttaaaagatcgagatgtgacttggcatttgattggtaccttgcaaagacgtaaggtgaaagatgtcattcaatacgttgattatttccatgcattggactcagtaaagctagcaggggaaattcaaaaaagaagtgaccgagtcatcaagtgtttccttcaagtaaatatttctaaagaagaaagcaaacacggtttttcgagagaggaactgctggaaatcttgccagagttagccagactagataagattgaatatgttggtttaatgacgatggcaccttttgaggctagcagtgagcagttgaaagagattttcaaggcggcccaagatttacaaagagaaattcaagagaaacaaattccaaatatgcctatgaccgagttaagtatgggaatgagtcgtgattataaagaagcgattcaattcggttccacttttgttcgtataggtacatcattttttaagtaggagagaaccatgtctttaaaagatagattcgatagatttatagattattttacggaggatgaggattcaagtctcccttatgaaaaaagagatgagcctgtgtttacttcagtaaattcttcacaggaaccggctctcccaatgaatcaaccttcacagtcggctggtacaaaagagaacaatatcaccagacttcatgcaagacaacaggaattggcaaatcagagtcagcgtgcaacggataaggtcattatagatgttcgttatcctagaaaatatgaggatgcaacagaaattgttgatttattggcaggaaacgaaagtatcttgattgactttcagtatatgacagaggtgcaggctcgtcgttgtttggactatttggatggagcttgtcatgttttagctggaaatttgaaaaaggtagcttctaccatgtatttgttgacaccagtgaacgttattgtaaatgttgaagatatccgtttaccagatgaagatcaacagggtgagttcggttttgatatgaagcgaaatagagtacgataatgatttttttaattcgtatgatttataatgcagtggatatttactccctgattttggtagccttcgctgtcatgtcttggtttccaggtgcctacgaatccagtttaggtcgttggattgtagcgttggtgaaaccagtgcttgctcccttgcaacgcctgcctttacagatagcgggtcttgatttatctgtttgggttgcgattgttttggttcgatttttaggagaaaacctagtgcgttttctggcgatgataggatgaataaagggatttatcagcatttctccatagaagatcgtccatttcttgacaagggaatggaatggataaagaaggtagaagatagctatgctccttttttaactccttttatcaatcctcatcaggagaagctattaaagattttggccaaaacctatggtcttgcttgtagcagtagtggggaattcgtctcgagtgagtatgttcgagttttattatacccagattatttccaaccagagttttcagattttgaaatatctctccaggaaattgtgtattccaataaatttgaacatttaacgcatgctaagattttagggacagtcatcaatcaattagggattgaacggaaactttttggagatatcctagtagatgaagaacgggcgcagattatgattaatcagcagtttcttcttctctttcaagatggactaaagaaaattggtcgtatacctgtttcgctggaggaacgtcctttcaccgagaaaatagataagctagaacagtatcgagaactggatttatctgtgtctagttttcgattagatgttcttttatcaaatgttttgaaactatctaggaatcaagcaaaccagttgattgaaaagaaacttgtccaagtaaattatcatgtggtagacaaatcagattacactgttcaagttggagacttgattagtgtgagaaaatttggtcgcttgagattacttcaagataagggacaaacgaaaaaagagaagaaaaaaataaccgtccagttattattaagtaagtgaggaatagaatgccaattacatcattagaaataaaggacaagacttttggaactcgattcagaggttttgatccagaagaagtcgatgaatttttagatattgtggttcgtgattacgaagatcttgtgcgtgcgaatcatgataaaaatttgcgtattaagagtttagaagagcgtttgtcttactttgatgaaataaaagattcattgagccagtctgtattgattgctcaggatacagctgagagagtgaaacaggcggcgcatgaacgttcaaacaatatcattcatcaagcagagcaagatgcgcaacgcttgttggaagaagctaaatataaggcaaacgagattcttcgtcaagcaactgataatgctaagaaagtcgctgttgaaacagaagaattgaagaacaagagccgtgtcttccaccaacgtctcaaatctacaattgagagtcagttggctattgttgaatcttcagattgggaagatattctccgtccaacagctacttatcttcaaaccagtgatgaagcctttaaagaagtggttagcgaagtacttggagaaccgattccagctccaattgaagaagaaccaattgatatgacacgtcagttctctcaagcagaaatggcagaattacaagctcgtattgaggtagccgataaagaattgtctgaatttgaagctcagattaaacaggaagtggaaactccaactcctgtagtgagtcctcaagttgaagaagagcctctgctcatccagttggcccaatgtatgaagaaccagaagtagctccagtgcatccgacaggtccaacaccagctacagaaactgttgattcagcaccgggatttgaagcaccgcaagaatctgttacaattttataagaaatattctgagaacaatatcttatccttatattcccagcgagcaggagatggtgtgagtcctgcattccctatcgataagattatcctctcaaactatcaagtctgaatctagtaagatttgacgttccccacgttacgggataagagggagaaagactaaaactttttccgaataaaggtggtaccacgattttcgtcctttttggaagtcgtggtttttaatttgttattatttataaaggagataccatgaaactcaaagacacccttaatcttgggaaaactgaattcccaatgcgtgcaggccttcctaccaaagagccagtttggcaaaaggaatgggaagatgcaaaactttatcaacgtcgtcaagaattgaaccaaggaaaacctcatttcaccttgcatgatggccctccatacgctaacggaaatatccacgttggacatgctatgaacaagatttcaaaagatattattgttcgttctaagtctatgtcaggattttacgcaccatttattcctggttgggatactcatggtctgccaatcgagcaagtattgtcaaaacaaggtgtcaaacgtaaagaaatggacttggttgagtacttgaaactttgccgtgagtacgctctttctcaagtagataaacaacgtgaagattttaaacgtttgggtgtttctggtgactgggaaaatccatatgtgaccttgactcctgactatgaagcagctcaaattcgtgtatttggtgagatggctaataagggttatatctaccgtggtgccaagccagtttactggtcatggtcatctgagtcagcccttgctgaagcagagattgaataccatgacttggtttcaacttccctttactatgccaacaaggtaaaagatggcaaaggagttctagatacagatacttatatcgttgtctggacaacgactccatttaccatcacagcttctcgtggtttgacggttggtgcagatattgattacgttttggttcaacctgttggtgaagctcgtaagtttgtcgttgctgctgaattattgactagcttgtctgagaaatttggctgggctgatgttcaagttttggaaacttaccgtggccaagaactcaaccacatcgtaacagaacacccatgggatacagctgtagaagagttggtaattcttggtgaccacgttacgactgactctggtacaggtattgtccatacagcccctggttttggtgaggacgattacaatgttggtattgctaataatcttgaagtcgcagtgactgttgatgaacgtggtatcatgatgaagaatgctggtcctgaatttgaaggtcaattctatgaaaaggtagttccaactgttattgaaaaacttggtaacctccttcttgcccaagaagaaatctctcactcatatccatttgactggcgtactaagaaaccaatcatctggcgtgcagttccacaatggtttgcctcagtttctaaattccgtcaagaaatcttggacgaaattgaaaaagtgaaattccactcagaatggggtaaagtccgtctttacaatatgatccgtgatcgtggtgactgggttatctctcgtcaacgtacttggggtgttccacttcctatcttctacgctgaagatggtacagctatcatggtagctgaaactattgaacacgtagctcaactttttgaaaaacatggttcaagcatttggtgggaacgtgatgccaaagacctcttgccagaaggatttactcatccaggttcaccaaacggcgagttcaaaaaagaaactgatatcatggacgtttggtttgactcaggttcatcatggaatggagtggtggtaaaccgtcctgaattgacttacccagccgacctttacctagaaggttctgaccaataccgtggttggtttaactcatcacttatcacatctgttgccaaccatggcgtagcaccttacaaacaaatcttgtcacaaggttttgcccttgatggtaaaggtgagaagatgtctaaatctcttggaaatactattgctccaagcgatgttgaaaaacaattcggtgctgaaatcttgcgtctctgggtaacaagtgttgactcaagcaatgacgtgcgtatctctatggatatcttgagccaagtttctgaaacttaccgtaagattcgtaacactcttcgtttcttgattgccaatacatctgactttaacccagctcaagatacagtcgcttacgatgagcttcgttcagttgataagtacatgacgattcgctttaaccagcttgtcaagaccattcgtgatgcctatgcagactttgaattcttgacgatctacaaggccttggtgaactttatcaacgttgacttgtcagccttctaccttgattttgccaaagatgttgtttacattgaaggtgccaaatcactggaacgccgtcaaatgcagactgtcttctatgacattcttgtcaaaatcaccaaactcttgacaccaatccttcctcacactgcggaagaaatttggtcatatcttgagtttgaaacagaagacttcgtccaattgtcagaattaccagaagttcaaacttttgctaaccaagaagaaatcttggatacatgggcagccttcatggactttcgtggacaagcacaaaaagccttggaagaagctcgtaatgcaaaagttatcggtaaatcacttgaagcacacttgacagtttatccaaatgaagttgtgaaaactctactcgaagcagtaaacagcaatgtagctcaacttttgatcgtgtctgagttgaccatcgcagaagaaccagctccggaagctgcccttagcttcgaagatgtagccttcacagttgaacgtgctgctggtgaagtatgtgaccgttgccgtcgtatcgacccaacaacagcagaacgcagctaccaggcagttatctgtgaccactgtgcaagcatcgtagaagaaaattttgcggatgcagtcgcagaaggatttgaagagaaataaga

SEQ ID NO: 35 - DNA, 8000 bp, Streptococcus pneumoniae
tatgcaagctatgattccgttactttacttcgtgtcaaaaaagaggctcaggaaccgactcgtgaggtatttgaacaggaattggagaagtttgtaaactcagaacagagtttaatagctaggagaattgtagaaccgagtaaggatgggacgactcactttacttatgcaacttatggtcagggaacattaccaaaacaattccaagaagctagccaagaaagtcgtgaacgtagtgatccgctaaatagttatctccttttatcaggctccttgacaaaagaaaagctagctgataaattaggagatttaggttataaagcaattgctgaccgaaagacaccgccctattttcttgcttttcgaatattactaaatccccttattttaattagtttagcaatatttggcttatctttctttgctttagtgattatcactcggattaaggaaatgagagcagcaggtataaaactcttttctggtcagactctcttatccattatggggcattctttatctactgatattaagtggctccttctatcagccctcctttccttcctaggtgggggagtcgttctttttagtcaaggtttgttttatcctatcttgttagccacctatggttttgggattagtttctatctgttgtttttattggcgatttcaattttactaatgctcctttatctaatgagtttgagttacaaagcattagttcccgttattaagggaagattaccccttaaacgcctgatgattttaaccctattgtgtcagttggttgctgtctttacagtgggatacgctgttaagacaggtttgacgtcttaccaacgattgaaagaacttgaaatttcaaaacaagcatggcatgacagagtagactattatcaaatttcttttggcttaggtgacagagtaaatgatacagaaaatcagaataagtggtatgaattttccaaagaagcagttgaaaaagaacaggctctatttgtaaaagagaatctcattcattttgcaaatcctcaaggaaaaaatgaaaacggggaaacactggatacctatagtccagatgctaatgttctctatgtgagtccaagttatttagacaaggaaaatgtggctgtaaatgatgagactagacagaaactagctcatcttcaaaaaggggaatttggactcttattaccagaatctcttcgttcacaggaagcagaacttaagaaagtttttgaagaacgtttgaactattacggaaaatcaagcgaggataaagacgctcctttagagtatgaaatgagagcgattgttagctatcttccaacaggacaaaaacgctttgtttataataacggtgaaagtccagtatctattcagtacttaaccgatccgattttagttgtatttactccaacatctacaggtgatagtttcatttcaaaatatgtttggtctatcaatgctggaaaacaactctttatcaaaggatatgagagtgggctagaactcttaaagaaagctggaatttatgagcaagtatcctatcttaaagaaggaagaagtgtttatctaactcgttataatgaagttcaaactgaaacagcaactttaatcttaggagctattgttgggatagccagttccttattactcttttattctgtcaatcttctatatttcgagcaattccgccgagatatcttgattaaacgaatttcaggtttacgattttttgaaacacatgctcagtatatggttagccaatttgccagttttgtatttggtgctagtttctttattttaagcagtcgagacttggtgattggcttgctcactttattcgtctttctagctagtgcagttttgacgctttaccgtcaagcacagaaagaatctcgtgtttctatgacaattatgaaaggaaaataggatgattgaactaaagaatatatctaaaaaatttggaagccgtcagctattttcagatacaaatcttcattttgaaggtgggaaaatttatgccttaatcggtacaagtggctgtggtaagacaacactcttgaatatgattggacgattagagccatatgacaaagggcaaatcatctatgatggcacttctcttaaggacatcaagtcttctgttttctttagagattacttgggatacttatttcaagattttggcttaattgaaagccaaaccgtcaaagagaatctcaatctgggtttagttggtaaaaagttgaaggaaaaagagaaaatctctttgatgaaacaagctctaaaccgtgtaaacctctcttatttggatttgaagcaacctatatttgagttatcaggaggagaagcacaacgtgttgcattagcgaagataattttaaaggatccgcctttgattcttgcagatgaaccaaccgcttccttagaccccaaaaactctgaggaattactttccatcctagaatctttaaaaaatccgaatcggaccattattattgcgacccacaatcctctgatttgggagcaagtggatcaggtcattcgagttaccgatttatcacatagatgatatggtaagattcagttagaagaaagagtcacaaacacactttgtggcttttttatttccataaaaatggtaaaatagtaggagtagaaatggagttcgagacatgaaagtaatagatcaatttaaaaataagaaagttcttgttttaggtttggccaagtctggtgaatctgcggctcgtttgttggacaagttaggtgccattgtgacagtaaatgatgggaaaccattcgaggacaatccagctgcccaatgtttgctggaagaagggatcaaggtcattacaggtggccatcctttggaactcttggatgaagagtttgccctcatggtaaaaaatccaggtatcccctacagcaatcccatgattgaaaaggctttggccaagggaattccagtcttgactgaggtggaattggcttatttgatttcagaagcaccgattattggtatcacaggatcgaacggtaagacaaccacaacgactatgattggggaagttttgactgctgctgggcaacatggtcttttatcagggaatatcggctatcctgccagtcaggttgctcaaatagcgacagacaagaacacgcttgttatggaactttcttctttccaactcatgggtgttcaagaattccatcctgagattgcggttattactaaccttatgccaactcatatcgattatcatggattatttgaggaatatgtagcagccaagtggaatatccagaacaagatgacagcagctgatttccttgtcttgaactttaatcaagacttggtaaaagacttggcttccaagacagaagccactgttgtaccattttcaacacttgaaaaggttgatggagcttatctggaagatggtcaactctacttccgtggtgaagtagtcatggcagcgaatgaaatcggtgttccaggtagccacaatgtggaaaatgcccttgcgactattgctgtagccaagcttcgtggtgtggacaatcaaaccatcaaggaaactctttcagccttcggtggtgtcaaacaccgtctccagtttgtggatgacatcaagggtgttaaattctataacgacagtaaatcaactaatatcttggctactcaaaaagccttgtcaggatttgacaacagcaaggtcgtcttgattgcaggtggtttggaccgtggcaatgagtttgacgaattggtgccagatattactggactcaagaagatggtcatcctgggtcaatctgcagaacgtgtcaaacgggcagcagacaaggctggtgtcgcttatgtggaggcgacagatattgcagatgcgacccgcaaggcctatgagcttgcgactcaaggagatgtggttcttcttagtcctgccaatgccagctgggatatgtatgctaactttgaagtacgtggcgacctctttatcgacacagtagcggagttaaaagaataaaatatgaaaaaaattgtctttacaggtggggggacggttggacacgttaccctcaatcttttgttaatgcccaagttcatcgaagatggttgggaagtccactatatcggggacaagcgtggtatcgaacaccaagaaatccttaagtcaggtttggatgtcactttccactccattgcgactggaaaattgcgtcgctatttctcttggcaaaatatgctggacgtcttcaaagtttgctggggaatcgtccaatcgctctttatcatgttgcgacttcgtccacagacccttttttcaaaggggggctttgtctcagtaccgcctgttatcgctgcgcgtgtgtcaggagtgcctgtctttattcacgaatctgacctgtctatgggcttggccaataaaatcgcctataaatttgcgactaagatgtattcaacctttgagcaagcttcgagtttgtctaaggttgagcatgtgggagcagtgaccaaggtttcagatcaaaaaaatccagaaccagatgaattggtggatattcaaagccactttaatcataaattgccgactgtattgtttgttggcggttctgcaggtgctcgtgtctttaaccaattggtgacagaccataagaaagaactaacagagcgctacaatattatcaatctaactggagattctagcctgaatgagttgagccaaaatctttttcgtgttgactatgtgaccgatctctatcaacccttgatggaattggctgatattgttgtgacacgaggtggtgccaatacgatttttgagctcttggcgatagcaaaattgcatgtcattgtgccgcttggtcgtgaagctagtcgtggtgaccagcttgaaaatgcagcttactttgtaaaaaaaggctatgcagaagaccttcaagaaagcgatttgaccttggatagtttggaagagaagctttctcacttactaagtcacaaggaagattaccaagctaagatgaaggcttctaaggaattgaaatctctagcagatttttatcaattgttgaaaaaagatttatcataaggaaagtaaatgtcaaaagataagaaaaatgaggacaaagaaatcctcgaagaattgaaagagttatcagaatggcagaaacgaaaccaagaatatctaaaaaagaaggctgaagaagaggcggctctagctgaggagaaggaaaaggaaagacaagctcgaatgggagaagaatctgagaagtcagaggacaaacaggaccaggagagtgaaacagaccaggaagattcagaatcagctaaggaagagtctgaagaaaaagtagcatcctcagaggctgacaaagagaaagaagagaaagaagaaccagagtctaaagagaaggaggaacaggataaaaagctttctaaaaaggctacaaaggaaaaaccagccaaagcaaagattcctggtatccatatcttgcgagcattcacgattttatttccaagtctgcttttattgattgtctctgcctacttgctcagtccttatgcgaccatgaaagatattcgtgttgagggaacggtgcaaactacagctgatgatattcgacaggcttcaggcattcaggattcggattatacgattaaccttctgctagacaaggcaaaatatgaaaagcagattaagtctaactattgggttgaatcagctcaacttgtctatcaatttccaactaagttcactattaaggtcaaggaatatgatattgtggcctactatatttctggtgaaaatcattatcctattctttccagtggtcagcttgagactagttctgtgagtctgaacagtttaccagaaacttatttatcagttctctttaatgatagtgaacaaatcaaggtttttgtctcagaacttgctcaaattagcccagaactcaaggcggctatccaaaaggtggaattagccccaagcaaggtgacatccgatttaattcgattgaccatgaatgattcggacgaagtcttggttcctctatctgaaatgagtaagaaactgccatattacagtaagattaagccacaattgtcagaaccgagtgtggtcgacatggaagctggaatttacagttacactgtggcggataaattaattatggaggttgaggaaaaagccaaacaagaggccaaggaagctgagaaaaaacaagaagaagaacagaaaaaacaagaggaagagagcaatcgaaaccaaacgacccagcgctcatcgcgtcgctaggtttactttttctcttatagttatttagtgaccatgtttttacttgacaagtgctagtagaaataatagaataatagaaaacctttaaagcagtccagagaggcagctaaggttagacggtgaaagggtggagactacccatttttcgtggaaccttgctgttggcaggttccttttttcgtggcttctgttggtcagactctctcactagtaaaggtaaaaggagaaacctatgcgagaacatcgtccaatcattgctcttgattttcctagttttgaggcggtcaaggaatttttagctcttttcccagcagaagaaagcctttatctcaaggtagggatggagctttattacgcagcggggcctgagattgtgtcctacttaaaaggtttgggtcatagtgtctttttggatctcaaacttcatgacattcctaatacagtcaagtcagccatgaaggtcttgtctcagcttggtgtcgatatgactaatgtccatgcggctggtggtgtagagatgatgaaggcggcgcgtgaaggtcttgggagtcaagccaaattgatcgctgtaactcagctcacatcaacgtcagaagctcagatgcaggagtttcaaaatatccaaaccagtctgcaagagtctgtgattcactatgccaagaagacagctgaagctggcttggatggtgttgtttgctcggctcaggaagtacaagtcatcaagcaggctaccaatccagattttatctgtctgacaccagggattcgtccagctggtgttgcagttggagatcaaaaacgagtcatgacacctgctgatgcctatcaaatcggcagtgactatatcgtagtgggacgtcccattacccaagctgaggatcctgttgcagcttatcatgccatcaaggatgaatggacacaggactggaattaaagaactagattagaaaaataaaaggagaataccatgacacttgctaaagatatcgctagccacctcttgaaaatccaagccgtttacctcaaaccagaggaacccttcacttgggcatctggtatcaagtcaccgatttacactgataatcgtgtgacactagcctatccagaaactcgtaccctaattgaaaatggttttgtggatgctatcaaagaagcctttcctgaagtagaagtgattgcaggaactgcaacagcagggattccacacggagccattattgctgataagatgaacttgccttttgcctacatccgtagcaaaccaaaagaccacggagctggtaatcaaatcgaaggtcgcgtagctcaaggtcaaaaaatggtagtggttgaagaccttatttcaacgggtggttcagttcttgaagctgtagcagcagccaagcgagaaggagcagatgtacttggagttgtagcgattttcagctaccaattgccaaaagcagataagaactttgcagatgctggtgttaaacttgtgacgctttcaaactatagcgagcttatccatctagcccaagaagaaggttacatcacgccagagggccttgatcttctaaaacgctttaaagaagaccaagaaaattggcaagaaggttaggtcagtaagataaagagagacgaggctaccgagtctcttttaccattttatttaaaatatgacaatattttaaataaaataattgacaacgcttt

SEQ ID NO: 36 - DNA, 6000 bp, Streptococcus pneumoniae
agtcgacaatatgtatcatcactccgaaaaagaaagctcccagtatagttttaaaaatatgttttgtatttagaagagaactgataaaatttggattttcacttgttagggtatcaatgagtggaattataaaaaatatcactgttccataaatcgaacctgctttcagaccaggataacgtaactgtttcttttcttttttcatgagtttcctcctaatcctcatcttgatttttcttagtttttgcaatgcgacgggagatgaggaactgtatgctcgctccgaagaaaatagaaccgagaatacttgatacaccatttcttatagtgagaagagaatgaaaatagtcctgaccttcatctatgagtatactgagaagaggagttataaaaaacatccatagaccaaagaacaaacctgctttcagacctgggtagtgtagttgcttgctttctttctcattcagcatatctggttcaatgactgtgatgcctgtttttttcatttggtaggtgacatagccagaagcgatgagggcaatcactaaaatcagaggaggatagattagagccacttcttgagggtatttataggccagaaggagtggaataatatttccgaaaatcatcagataaaagaggacgataaagacttggttcccaatactatcggcctcacgccgtttgtattcgtcaaggggatcagaaataccgtatgtgcgtttgatcagtttttcagtgaaggtttcttttttcatgagtttgctccttttttaaaaatcttcctcccaaaagagactgttgaggtcagtttggaggctgcgggcgagattgagacagagttccaaggttggattgtacttgtcgttttcaatcatattgatagtctgtctcgagacaccgatatccttggcgagctcgagctgggaaatacccaattccttgcgaaattctttcacacgattcatctgttcttctttctgatttatgtcgtatatatttgactatattatagtcttttaaacataaagtgtcaagtatttttgacatattttttgaagaaatagtagtctccttgtcctatttgtctgacaagtgcaagctggtcggatttgtggtaaaatagataagatatgacaaaagaatttcatcatgtaacggtcttactccacgaaacgattgatatgcttgacgtaaaacctgacggtatctacgttgatgcgactttgggtggagcaggccatagcgagtatttattaagtaaattaagtgaaaaaggccatctctatgcctttgaccaggatcagaatgccattgacaatgcgcaaaaacgcttggcaccttacattgagaagggaatggtgacctttatcaaggataacttccgtcatttacaggcacgtttgcgcgaagctggtgttcaggaaattgatggaatttgttatgacttgggagtgtctagtcctcaattggaccagcgtgagcgtggtttttcttataaaaaggatgcgccactggacatgcggatgaatcaggatgctagtctgacagcctatgaagtggttaatcactatgactatcatgatttggttcgtattttcttcaaatacggtgaggataaattctctaaacagattgcgcgtaagattgagcaagcgcgtgaagtgaagccgattgagacaacgactgagttagcagagattatcaagttggtcaaacctgccaaggaactcaagaagaagggtcatcctgctaagcagattttccaggctattcgaattgaagtcaatgatgaactgggagcggcagatgagtccatccagcaggctatggatatgttggctctggatggtagaatttcagtgattacctttcattccttagaagaccgcttgaccaagcaattgttcaaggaagcttcaacagttgaagttccaaaaggcttgcctttcatcccagatgatctcaagcccaagatggaattggtgtcccgtaagccaatcttgccaagtgcggaagagttagaagccaataaccgctcgcactcagccaagttgcgcgtggccagaaaaattcacaagtaagagggaaaaagatggcagaaaaaatggaaaaaacaggtcaaatactacagatgcaacttaaacggttttcgcgtgtggaaaaagctttttacttttccattgctgtaaccactcttattgtagccattagtattatttttatgcagaccaagctcttgcaagtgcagaatgatttgacaaaaatcaatgcgcagatagaggaaaagaaaaccgaattggacgatgccaagcaagaggtcaatgaactattacgtgcagaacgtttgaaagaaattgccaattcacacgatttgcaattaaacaatgaaaatattagaatagcggagtaagatatgaagtggacaaaaagagtaatccgttatgcgaccaaaaatcggaaatcgccggctgaaaacagacgcagagttggaaaaagtctgagtttattatctgtctttgtttttgccatttttttagtcaattttgcggtcattattgggacaggcactcgctttggaacagatttagcgaaggaagctaagaaggttcatcaaaccacccgtacagttcctgccaaacgtgggactatttatgaccgaaatggagtcccgattgctgaggatgcaacctcctataatgtctatgcggtcattgatgagaattataagtcagcaacgggtaagattctttacgtagaaaaaacacaatttaacaaggtggcagaggtctttcataagtatctggacatggaagaatcctatgtaagagagcaactctcgcaacctaatctcaagcaagtttcctttggagcaaagggaaatgggattacctatgccaatatgatgtctatcaaaaaagaattggaaactgcagaggtcaaggggattgattttacaaccagtcccaatcgtagttatccaaacggacaatttgcttctagttttatcggtctagctcagctccatgaaaatgaagatggaagcaagagtttgttgggaacctctggaatggagagttctttgaacagtattcttgcagggacagacggcattattacctatgaaaaggatcgtctgggtaatattgtacccggaacagaacaagtttcccaacaaacggtggacggtaaggatgtttacacaaccatttccagtcccctccagtcctttatggaaacccagatggatgcttttcaagagaaggtaaaaggaaagtacatgacagcgactttggtcagtgctaaaacaggggaaattttggcaacgacgcaacgaccgacctttgatgcagatacaaaagaaggcattacagaggactttgtttggcgtgatatcctttaccaaagtaactatgagccaggttccactatgaaagtgatgatgttggctgctgctattgataataatacctttccaggaggagaagtcttcaatagtagtgagttaaaaattgcagatgccacgattcgagattgggacgtcaatgaaggattgactggtggcagaatgatgactttttctcaaggttttgcacactcaagtaacgttgggatgaccctccttgagcaaaagatgggagatgctacctggcttgattatcttaatcgttttaaatttggtgttccgacccgtttcggtttgacggatgagtatgctggtcaattgcctgcagataatattgttaatattgccatgagtgcatttggtcaggggatttctgtaacgcagacccagatgctacgtgcttttacagccattgccaacgatggggttatgttggaaccaaaatttatcagtgccctttatgatccaaatgaccagtctgttcgtaagtctcaaaaggaaatagtcgggaatcctgtatcgaaagaagcggcatcagtcacgcgtgaccatatggttatggttggaacagaccctacatatggaactatgtataatcatagtacaggcaaggcaactgtcaatgttccgggtcagaatgtggcccttaaatcagggactgcggagattgcggatgagaaaaatggtggttaccttacaggttcaacaaacaacattttctcagttgtatctatgcacccagcggaaaatcctgactttattctctatgtgacggttcaacaacctgagcattattcaggtattcaacttggagagtttgccaatccaattcttgaaagagcctcagctatgaaagaatcactcaatcttcaaacaacagctaaagctttggagcaagtaagtcaacaaagtccttatcctatgcctagtgtcaaggatatttcacctggtgatttagcagaagaattgcgtcgcaatcttgtacaacctatcgttgtgggaacagggacgaagattaaaaacagttctgctgaagaagggaagaatcttgccccgaaccagcaagtcctgatcttatctgataaagcagaggaagttccagatatgtatggttggacaaaggagactgctgagacctttgctaagtggctcaatatagaacttgaatttgaaggttcgggctctactgtgcagaagcaagatgttcgtgctaacacagctatcaaggacattaaaaaaattacattaactttaggagactaatatgtttatttccatcagtgctggaattgtgacatttttactaactttagtaggaattccggcctttatccaattttatagaaaggcgcaaattacaggccagcagatgcatgaggatgtcaaacagcaccaggcaaaagctgggactcctacaatgggaggtttggttttcttaattgcttctgttttagttgctttctttttcgccctatttagtaatcaactcagcaataatgttggtatgattttatttatcttggttctttatggtttaatcggatttttggacgactttctcaaggtcttccgaaaaatcaatgaggggctaaatcctaagcaaaaattagctcttcagcttctaggtggagttatcttctatcttttctatgagcgcggtggcgatatcctgtctgtctttggttatccagttcatttgggatttttctatattttcttcgctcttttctggctagtcggtttttcaaacgcagtaaacttgacagacggtgttgacggtttagctagtatttccgttgtgattagtttgtctgcctatggagttattgcctatgtgcaaggtcagatggatattcttctagtgattcttgccatgattggtggtttgctcggtttcttcatctttaaccataagcctgccaaggtctttatgggtgatgtgggaagtttggccctaggtgggatgctggcagctatctctatggctctccaccaagaatggactctcttgattatcggaattgtgtatgtttttgaaacaacttctgttatgatgcaagtcagttatttcaaactgacaggtggtaaacgtattttccgtatgacgcctgtacatcaccattttgagcttgggggattgtctggtaaaggaaatccttggagcgagtggaaggttgacttcttcttttggggagtgggacttctagcaagtctcctgaccctcgcaattttatatttgatgtaagaatggcaccctgatgtttcagggtgtttttgtgtttaaatacacaatgaaaatcaaagaacaaactagaaagctaactttaggctgctcaaaatatagtagattgaaactagaatagtacacatctacttctaaaatattgttagaaatcgatttgactgtcctgattgatttgtcctgttcttatttcgttttaatatacagttttgagatggttgatagaactgacgaagtcagctcaaaacacggttttgaggttgtagataaggagaagctgatgtggtttgaagaggttttcgaagagtgtaaaaaaatattggtcagttaaagtcaaaactcttgacctttt

SEQ ID NO: 37 - DNA, 21570 bp, Treponema palladium
tgccagtttcgatataactgtaggggtgtactttgaaatgccgaagtagtgggagaccctgtcttccgcgcgtgtaatgagaaacgcccctatctggctgagaaagtggatggcatccgttttttcctttttactcatgagcgctgcaggttttcctactctttctacagactcttctatcaggtcgtcgaggaacgcactgacgctcttaaggtggatatgcgaggcggtctccgcagcagtgccggtgagccggccaagcgcaaactgcgtaacctacaaagcagtaatatcaaagtttatcgctagaatcgcctgagccgtgctatgttcgtcacgaatatacaacatgctcgacttaagggagcggcagttctccgtgcgaatgaggtagttgagccgcccttgcctgtttctattccgtaattcttgaagagcgacaggcggggtctgtctccaaccctgctactggtaacgcgtccatttgtgataaaatcaaccgcgcagtttttaccatcgctactgacgccgtacacagccacctcacagtcatgcccgaaatgagacgcgatcccctgagcaacttgctgcaggatttgcactgtctatcccttttttactgcatcgacctcgttcatatgcctctctcggtaagtagtttctttatggtttgcttgatctgtgcaacccgcgcagcatgcggatgggctgcaacagcttttcgcaagcacgcgactacgtcctctgtagataccttttctgaaagagcataggtgtatgcggtcaggtaccacgcttcctgtttttgagatgcactcagaaacggtgactgcgctaaatccttgtaagcattccccgctgctacaaggttttcttgcttgataaatttctctgcgcgccgccgtgccaggtgaaacatgtaatccccgtggagacctgagacattttcgtgatcagcctggagtgcttcttttcggagggcgtcgtaccgcgcagagcgtgggtaacgcaccgtcttaagaaatgcatcgatggcaattgctttttcagcagcttcggtctgagcgatacggtcacgcgccgccagcactttttttctcgaagcgtccgcagaccgtattagcgcccacagctcctgctcgctcgacagcgtcgaatgtatgcgctgcgcaaagtaagcgtccccttgtgcgctttggagaacaaggaacggaaggccatcaacctcatactccgaaaacaacaagcgattacgttcgcgcgcctcaggggaaagggtgtatgcgctgtgaggagcctcgacgcgaagaaagcgatacgatttggaaagacgcgcaaccaattcaggggtaaagatggtgacagatgcacccgtctcgttgtaagagacaaatagcatcagcgcctctctcgtctctgtctgagaaacctccagaaccgagagcgggtctgtgaccgcatcactctgacccgtggcacaaccggacagcgcagcgctgcgcaaacggaaagcaacagacttgtcttcacgaaagaacacccatgcccgcccccagtgtacgagggtacaagggtgctgtcaagcaagtctttatcgctgtgcagtgagtgttgtgcgtgctacaatgccccatgactgaggagactgcacaacgtgttatccgtgcattgagaactgtcgcagcgctcatcgtctgtgtgttacttctcggcactgcggggcgttccgtgtgaggacacacagtgctccaagggaaacgcagactaggcgtacaacccgggggattgcccagcgggaatctgcccatgcagtctatgcagaacttggacgcttgcgcgcgctgagtgcggataagcagcctgtgagtgtcatcattaccccacttttgcaatatcctgccgcagatcacgccctgtatgaggagctcgttcagaaaaaagaacaactgagacgtgcgtctcttgcgtggtgtgcacagcacaccgcgcaagaattgcatatgcttggccccgagcagctaaaaattgccttgcgcgatgcgctcaacacacagctgagtctcgggagagttacccatgtctttcttgaagaatttatcattctgttctgagcggcggtctttacctggaacaggatagacatctggatggtcctgcccatcaagcaaaataatgagattgctcttcagcggccacaacagtgtttgtactttttgccacttccacaggggcagggggtgttgcgccccacttttgcgccggcttgaatcgggagagcagatagcgatccgtgccctctgccaggctgccccagtgcttgaaattcgtgtgccgcctgtgcaacgtgtggtggcctcgggacgcgctgctcttccatgtgaaccgttacgcgcacaacctgcgaggcgatcgaaaggcgaatgtcgtctaacatggtgtaaaataggtcgaacccttcaagcttgtattcggtaagcgggttcttttgcccatatgaacgcaagtacaccgattcccggaggatttcaagaagttccaaatggtccagccattttttatcgatcgcctgcacatactggtagcggatgaacgtatccatgttctgcgcccctgcaagcagatactttgattcaatattcttttttaaatgcgccaggatttcttgcttcagcgttccaagacgcgtttcgttccagccagatgcgtcctcacctcccagtgcgtaatcgaacagggtgctcaggttttgttgaaacgccccgagggaaagccgcccacgccgcttcaattcttgccgaagtgcggttatttctcggttaagatactcctcgattgtggtatacacgcgctctaccacatgctcgtctatcaaaatttgtgctcgctgcgcgtatatgaaggagcgctgttcgttgagcacatcatcgtattcaagcaagtgcttacggacatcaaagttgcgtgcttcgaccttcgtctgcgcgcgctcaatactcttattcaaccaggaatgcgtgataggttctcctggttccatacccacacggctcataaaacgcttcagccgctcccccccaaaaatgcgcataagatcatcatccagagagagaaaaaattttgagcggcctggatccccttgacgccccgaacgcccccgaagttggttatcaatgcgcctgctttcatgccgctctgtgccaatgacgtacaaaccaccgagctgcttaacctcttcgtaatctgcgcgccaccgtgtgtattccgcctcatagcacgcttgcatatgttcctgcacagtgacagaggaggaaccgtgcttcgatgctatggcagttgcgctctgtcgtgcacgaaattcaggattaccccctagcttgatatccgtgccgcgtccggccatgttggttgcgatggtcaccgaacccttcgcccccgcttcggcgataatcagtgcctcgcgcgcgtgatttttagcgttgagaacttcgtgttttacaccgcgtgttctcagcagagcagagagtttttcggacttttctatagaaatagtgcccacgagtaccggctgtccccgtgtgtgtgcctcctttatttcatcacaaatggcactccacttttcttcttcactcaggtataccacgtcatgctcatccacccgcgctacgggaagattcgtcggcaaaactaccacctcaagtttataaattttattgagctccaacgcctcggtatccgcagttcccgtcattccagaaagctttttatacattctaaaaaagttctgaaacgtgatagttgccatagtgcgattacgttgcgcaatgcggatgtgttcttttgcctcaattgcctgatgtaatccgtcagaataccgccgaccttccaagatgcgaccggtaaactcgtctacgatctgtacttgtccgtcttttactacgtaatcaacgtctgcgcggtaaagtaagtgcgcacggagtgcctgcgtaaagtagtggatatacttgaagttctcttcatcaaatagactcccttggataagcccagcgtgcgtgagcacatcctgaatgtgcagcatccccggaccactgaaggaaaccttgcgattcttttcatcaacgatataatcgccgcgaacctcctctccgtccacttcgttggggtagtcacctgtggcaggatttcgctccacttcctgtaactgcccgacgagtctgtcaacctcggcgtaatgctgggtatcattttctgcaggccctgagataataagcggtgtgcgcgcctcgtcgatgagaatggagtcaatctcgtcaataatggcaaagtaaaaatcacgctgcgttttttcttccgttaaaaattgcatgttgtcgcgcagataatcaaagcccagttcattgttggtaccgtaggtaatatcgcacgcgtacgcacaccgccgctcctgactgcccatggaagagaggatgacgccgacggaaacgcctaaataatcatatactggacgcatccatcgcgcgtcgcgctcagcaagatagtcgttgaccgtgacaatatgcacacccctccccgaaagactgttcagatacgccgctgccacgctcatgagcgttttgccttcgcccgttttcatttccacgattttgccgtggtggaggacgagggaaccgaggatctgcacgtcatagggacgctcgcctaaaacacgacgagctgcctcgcgcgcaagcgcaaatgcctgaggtaaaaaagcgtcaagcgcttctcctgcagcggcacgcgccttaaactcagctgttttttgtttgaactcagactcctggagaggaagtacccaggactcctgggcgttgacggcattcaaaagaggcaggagatttttcagatcgcgctcgtgctgggagccaaagatgagcctgagtgcagtgcgtacgagcatggagtactgtagcggtcttgaaccaaaaaaacaagggagaccgcacggtcaccccctcctcccccccccctcacacacacagggaggactctgcacggagtatcctttattcgtgtacttcgcttacgcgaagggtttcgtacgtgtaaccctgctctaccaaaaaccgctggcgacgcagtgcacagtcttcttccaccgtttgttctgtaactaacgagtaaaaatgggcgtcgcatatctttggccgtaagaggcgtccgaggcgttgcgcctcctcctgacggctgccaaatgtcccggaaacttgaattgcaaccgacgcgtcaggaagatcaagcgcacaatttgccacctttgatacaacgagcacctggagcgtgccctcgcgaaaacgctgatagatggcttcacgcgccgcataagtttgtcttccgctcaccagtggcacctgcagtacgtgtgcgagatgtaataactgctgcacgtattgcccaataatcagtgtaggcgcacctgcatgtgcgcgcaatagacgctgtaccaccgctacttttgcttcgttctcgctggcaaggcgatgtcgcaggcgcacaggagctgtcatgtactggtactggagtgaccggtccatcgttacccgaacttctacgcaccgcacccgtgcgatccagccgcgtgcttctaaatccttccacggcacgtcataccgcttcggtcctacgaggctgaacacatcctgcgcacagccatcttctcgcacgagcgttgcagttaatcccaagcgtcgtaccacctgaagttctgcggtgatacggaaaagcggtgcagggagcaagtgcacctcatcgtaaataatcaaaccccaactgcgttccataaagagacggaaatgggaaaagggagcgtctgcatgcgcacgccaggtgagtatctggtaggttgcgatagtcactggtctgatttccttgcattctcctgaatagataccgatggatgtcccgtccaggtcggttttttcacacaattcacgtttccattgctgtgcagctgcgctattaggagtcagaatcagggtatccgtttgcaacagacccataacgagtaaaccgacaaccgtttttcccgcgccacacggcaaaactaccacaccaaatccgctcccttgtgtgcgattcccgacgaaggcatcggctgcttcccactggtagtcacgtggcacaaacgagggtgtccctggcgtgtgacaacacggatacgcagtagaaggaggaggacacgaagccggagagatgcgtaagcgcaaggataggggagttccctcgcggagaggcacttcatcatgcaccggccatccgtggcgcaagagtaattgtttaacggtgcctcggtggaggcgtggcaatagaaagtcgtaactgcatccagtctgtgcaccctgcacctgaggtgtcgtatccggctgggcaatgcgcgcagtgtccggtgtgggcagcggaccgtcctgcaggcaagcggttgtgggggaaaggtgcgatgcaagactttttgaggcggcaatttctcttgcgatgtgtgcgtcgcgtacctgaaggcgcagtagggtgctgtgcgtcgtatcctcgcgaaggcgaattttgccatagcggctcatgatatccactacccagtcgagtactgtttgcgggggagtgaagcgtgagaaacgcgtcagtgtttgtgcaatcatctgggggctgaatcctgcgctcgcggcgttccacagagaaagaggagtgagtcggtagctgtgtagatgctctggagatttttccagttctgcaaaggaaacgagcgccttgcgtgctgctaccgcctcaggagcgtgcacatcaagtaaaatggagcggtctgcttggatgataagcggttttggtacagaagtcacagcgcaccattatacgttcgcgttgaccgcggagtaaggccgtgtgacgcaagcgcgctgcaactccaccacgatgtcccaacggcacgcgtgccctctgccttggcagaagggtccgatggaaccacagcgagcagctaaatgacgaagagctggtttcttccgtgttggcttggccggaagggtaggtagagtaccagcattaacaggcacagtgcactgacaaacagcagctgatacacaaaaaaaggacggattacccgaaggatctcaagcgggtatttgctaatgaaaaggtaattggcgccgagtctccgattccaaaagagtgcgtttgctgcaagcagaagaaagccaagcactgcgcattgcaggccacgcttgctaatgcgctcgcgcaagtggagcaggctgaacacgaccatcgcaggctcaaggcaatgggtgagcatgaacaagtacgcgtacaagatggtgtgcgcccgagtgagatccggatagagtaccgcaacgaaagagccaaaatgccaaaagtacagcagattgaaaaagataggtcggcgggtgatgaaatacagcgaccctgaaatgagcgctgcggggcacaggtgaaagggaagctcgttacgccacgaacgcccgtctaagagcgtaccacacagcatgaggcccagacgcaaaaaaaggattgcaacccccgcgcgcgctaggttcttgtgcgcaagcagccgcggcagcgcaaacggaagcagcacgaacaaggcactgagaagaacggcgaccgacgcaattgcaaagtgcaacgcaccaaaccgcacaaaaagacccgtatccgccagctctgcacccagcatacgtccacccccccccccccgacgagaaaaagaacattgtcacccataccgttgccggttgtccagtaaatttttgcgatagggtgggggctgcggggaaagaaggagcacagtgtcagggaggggatgtatgtgagctggtccggcacaggttgacaatgcaggcggatgtgctagaatccgggggagtttgtgggaggatttaggaaaaatataggggaaggtaggaaatcgtggaggataacgcctttactggagcgtactcgtacaatctcgatgaaaaggggcgtctcatgcttcctgcgcgcttgcgtgttgcgctgagtgatacccgcttggtgctcacttgcgcgattgagtcctgcctgtgggtgtttccccgtgcgcagtgggaccgcttttcttcccagattagtgcgcgtgcttcgctgttccacgcgccgtctcgtgcagtgctgcgtcgccttattgctcctgcccaggaggttgagcttgatcgcgcgtggcgcctctttattcccccttccttgcgcgagtatgccgccttggaaaaggattgtcttattctggggctcagccactgccttgagatttgggaccgcgcgcgctaccgcgcctatcttgcagaaagtgaggcggacttccgtgcaggaaccgaaacactgcaggacctttgtctgtgagtctttccgggcatacgcacacaaaagaggaggtgcaggctgaggtggaggcaggagaggttcagtgcccagcgctttgccatcagccggtactcgtgcaggaatgcctgacgttgttggaacctgcaattgtgggtatctcgcgaggtgcagacagcacgagagatggggcgggggcgttttttattgacgggacactgggggatgggggacacacacaggcgtttttgcacgcgtaccctgcgctccgtgcgctcggtgttgaaatagatccgtcaatgctcgcacgggcgcgagcgcgcttgacgccgtttggcaagcggcttcgctatgtcctggggtggtctgatgtcttttttgcctccgcatatgcatcagctcctgcctctcctgcaacgggaaggactgcagctggcgccgcaggtgtgccgggtgcgtatccggcgccgcaggcagtattgttagaccttggtatttcttttttccattacaggggggcgatgcggggcttttccttcgcagaagaacatatgttggacatgcgcctggatcctcaagcctcccagaccgctgcagacctcctgaatcggctgccgcaggcacgtttggcacaattgttttttgaagggggagaggaacgttacgcgcgtcggattgcgcaggcggtgtgcgcgcagcgtcggcaggcgcccttttgctctgcgcgcgcatttgcagaagtcgttgcgcgcgtggtgccgccgatgcggacggcgcggtttgggaagcggcgcggtgttcttggggttttgccgaagctccatccggcaaccaaggcgtttcaagcattgcgcattgcggtgaacagggagcttgagcgtttgccacgccttcttacggcagcgtttacggcgcttgcgcctgggggtcgacttgcggttattagttttcactcgcgtgaggataggattgttaaggtacattttcggcactgggcgaaacgctgcagctgtccggctcgtgtgccgatatgcagctgcggcggtgtggcgcgtgcatcgctgattaccaagaagccgcttgtaccttcgtgtgtggagcgtgctgcgaatgccgcttcgcggagtgctacgttacgcgtcattgagaaacggtaggagactgggctgatgcgtgagaaaggggcgatgagagaaaagcagcgaaggggaatacctcgccggcaaagagggatgacggtgcaaaaggtgagcgcgttgttctttacggtgagtatccccgtgttgctgtgtgcgggggtgtggcaggcttcgcgctatcaggcggttgagcgtgtggtgcgtgagtacgacgcagagcaacaccgtattatcgcagaaaataagcgtaagatttctgggatcgcgatcctgtctaagccggatcgtattgaaaagctcgcggtagagaaactgcacttacaccgggcgtcgcacgccgaaattgtgcgcattaagctgcgtcctgcgcacaaggactcctcccctcatgcttctgagttttgatgaggtatgtgcggcagtgcaaggggctcgcgtgtgcgatgcacgaggggcgcgcggttttgacggggtttcctttgacagtcgtgcggttgtgccgcgtgatttgtttattccgctccgtggtgcgcacgtagatggacatacgtttgttgaagaagcgctgcagaagggcgcagttgcaacgcttatagatcaaaggtacccccatgctggggaatatgttgcttggtgcactcgctttggagctgcctgtattgcggtgcacgacacgctcagggcgctgcaagatcttgcctccttttactgcaaaaagtttcctgcgcttattaggattggcattaccggatcaagcggaaagacaaccgtaaaagaaatggctcgcgcggtgttcagtgaacggtatcgggtggttgcgacgccaggaaatttaaattcagagataggtttaccgcagtcgctgttttttgtgcgtgcagaacatgaggtaggaatctttgagctggggatgaatcgtcggggggagatgcgtacgctcgctcagatacttgttcctcattacgcgatcattaccaacgtaggttgtgcgcacgtaggcattctgggcacgcagcaggcaattgcggaagagaaaaaagagattttttctcaatttactgaacacagcgtgggttttgtccccgacgatgcatatcgtgtattcctgtctaatatcccgtacggtagggttgtagtttacgatcagggggggcgtggtctagcaactgaggtgatagatgagggtttacgtggttctcgcgtgttatatcaaggacgatggattcgcgtgccactacctggggtgcataacgcaaagaatgcgcttgcagtgattgcgcttgccgcacaggtaggacttcctgctgaggaaattcagcgggggatggagcgggtaaaaccgccctttggccgctctcatgtggtgtgtgcgtcgctgacctttttgctcgattgttacaatgcgaatcctgattcaatggctgcggcgcttcatttgtgtgcgcatatttctgcagtatcaaaagtatatgtgctcggtgacatgggagagctaggagttaccgctgccgaagctcactatcgggtgtgtgttttggcagccgcttctgacgcgcgtgcagtgtatgtgtttggtcccgaattttgtcgtgcggtaagaaaagtttcctgggggaggaagcgcgtgtacgcctttgcactagaggaactgtctgcgctgcaagaaacgttagacgcgcaattacggcggggtgattttgttctggtgaaaggttcacgcagtgttgcgctcgagcggcttgaacctcttttgaggaaagagcgatgagaccgatgatttccatcgagaaaaatgtacatcaagagcgttacagttttgtattcatactgcttgtcgcccttatggtaggagtaggttttgtaacgctttattcagggtcggtgcattatgcgcagcgcttttttcgttatcctggttattttttggtaagacagggagtgagtataggcatcggtcttgtgtgtttattgttttttacctttgttcgtttagcttctttaagaaaagcattgtctcctttgattctcgttgcatttgcgctctgtgtgtgcacgtttttccctggtattggttcaacgcgcaatggagcgacgcgttggattaaggtgtttgatattaattttcagccatctgaatttgtgaagctggtactcattgtttttcttgcaaacttttttgataagcaccgggagcatttcgatacacctatacgatcaatttttcctccctttgttgtgagcgtgatttttgtgtcagtagttttttttcaaaacgatttttctaccgctatgtttttgctttttatcacagtggttatgttcttcattgcaggtgcgcctctgtggtggtttttaagaggcataatggttcttgcgccgatagcagtgcttatgatcgtcacgtccaccaatcgtttgcgtcgagtgctttcatttttgtatccagatagagacccgcttggcgcaggataccaagtaaacgcggcgctcgaggcactgatggatggagggttgtgggggcgtggtattggaaatggggtgaggaaaattgcgagcgtgcccgaagtatattcggattttatttttgtcgttattggagaagagatgggattcattggtgtgtgtttatatttaatgttgttgtttgcgtttaccctcactggcatttctatcgcactcagatgtgctaatcgctttaatacttttttggctttcggcgcgtcggcggcaattgttttacagtcaattttgaatgttgcagtggtggtacgtctagttccagccactggtattcctcttccctttttttcttcaggaggttcatctattgtggtaacgctttctttatgtggattgatcatcaatgtttcaggggatgagaagataaggagggagcgtgaagaaacagtttttgtgtagaaatactgaagcgtgcaagtaccctctggtagggtatatgtctatgcgggtgagagttgcagtactgaaggtggtaattgttatattgctgctcgtgttgtgtgtggagtttgtattttatctttttgttgttccggcaacttcttttgcaaaggtagaattttcaggaaatgtgacgatatccccggaatatttgatgaaggctgcagggctcactggtaaagaaaaatggatgagtttggacggttttacaatttcggaacgactggcatctgttccgttacttgctcaggtagaggtgttaaagaaatttccagatacgatgcatgttcatgtggtagagcgtgttgctattgcacttggttttgtgcacgttcaaggccgtgcgatgccggtgcagattgacaagacaggaacagtttttagtgttgggacggcacctcttgatacagtattgccggtagtaagtggtcttgaatttcgtaatccgcgcgtggggctacgcgtgcacgatcagcttgttcctctttttgtgcagttagataatttgagcaagcggaaccctcttttgctcggtgaaatttctgagataagcattgaacaaaaaagacacgggggatatgatttagcgctttacctggtgcgtgcacctatcagagtacgcatggacaaaaaccttagcgaagaaaagttgcggtatgtcatattgctcgttgatgcgctgcgggagtggcaaacgcagaggcgcattaaggagcttgacgtgagaggtgggacggcggtgtatcgctagaagaggaaagttatgggtgaggttattgtcggcttagatatcggtaccgaatcgatcagggcggtagtggccgagcggttggaaggtggtgcgttacaggttgtaggtgtaggcgtcggtcattcaaagggtttgaggcggggtgtagtagtcaatattgagaatacagttgtgggtatccaccacgcggttgaagctgcggagatgatgtccggtatcgaagttgcgcactgcgttgtggggcttggaggtacccacatcgagggtagaaatttaaaaggtgttgtggcggttgcagataaggggaaggggcatcgcgaagttgatcaaagcgatattgatcgggtgcttgaagttgcctgtgcagtttctcttcctcccgatcgtaaaattcttcatgttattcccaaagtttattcggtggatgatcagcacggcatcaccgatccgcgcaatatcattggggttcgcctggaaggcgaggtgcatatgatcaccggttctgcaacgtgtatgcgcagtgtaatcgattgcgtgaaacgggcgaacttgcacatcgattttttaatgcataacgggctcgctgctgttcgttctgtgttaaacgatgacgagcgaaatgtagggtgtgtgctcattaatattggtgggggaactacggatgttattgcaatgtacaagggttccccggtgcttatcacttcgattcctgttgggggcagtcaggtaacttctgatcttgcaaaggtaaaaaacctcccgcttgaaactgcagagcgcattaaaattaaagatggatgttgctggatccccctgcttgagggagaagggagtgttctcatctccagccagggaaatcggattcctgtagaaatttctaaacgagaaatcgccgaaataattgaagcgcgcatgtgtgaggtttttacgatagtgcgcgatcgtctttcgacggtggagacgcaaagcggtcgtggtatcattgaaaatattattctctgcggcggtggcgcgcagcttaccggtgcggtagagcttgcgtcagcaatttttgatacaccgcgcgtgcaccttggaataccaggtactttgggaggattggcaggggaatatcgcagtcctgagtttgcagtggtgttaggactgattttagaatatacccataagcagggacagcgcgcttatcagggccgtgctgagatggagcgtgcgggagtgtttactaaagtgaaggatatttggaggaacttgttttaaaccgcgcacagcatgcggcacgcggtgtaggggaatgggaggggaatgatgaatatagagcttgcaccttcaggcgaagagtttaccctaagtccaacggtcataaaggtcatcggtgccggtggtggtgggtcaaacgcggtaaataggatgatgagctgcggtttgcagtgcgtcgagtttattgcagcaaatacagatgtgcaggcgttgagctattctaccgcgcctaaaaagcttgccattggcaccaaggtgacaagggggttgggtgcaggcggtgatcctgagattggcgagaaggctgcaatggaagatgctgaagccattgcaagtgcgttgcagggcgcgaacatggtgttcatcaccgcagggatgggaggaggtacgggaacaggtgctgccccagttattgcaaagattgcacgggaacttggtgctttgacagttgccgtagtcacgaagccgtttcgctttgaaggcagagcaaagatgatgctcgctgagcgagggatcgaaaaattgcgcacgcactcggacaccgtgattgtgatccctaatcagaatttactcagtgtggtagataagcgctgcccgattaaagagacgtatctggttgcagatgatctgctgcgcaagtcggtgcaaagtatttctgatttaattacccttcctggagaagtgaatttagatttcatggatgtaaaaaacaccatggaagggcaggggtacgcgcttatcggtgtgggagagggagaaggggaaaaccgcgcagtagatgcggcaaccgctgcaattaataatccgcttttggaagagacgcggatagaaggtgctaccagactgctggttgcggtacgtggctcagagaacttgagcatgggagaagtcgatggcgtgatgtctgtggttgcaaagaccattgatccggatgcgattatcatccatggcacgtccatcgacgcgagtatgcaggatagggtgagggttacggttatcgcaacgggtgtaccgcaagcgagtatttcgatagcgggagatacacacagttctcaaaagataaaaacatcatcgtacggtgcggtgagtaccggtgtgtatattagttctgacgaatggaacagagctaaaagctctaaacagccaaacttacctggtctggctacgcgtaatagcgctgttcaagaaacgcgtatggaaaagaacggagtgaagggccacacgtttggcgttccgctcccctcggtaaatgaagatttggatgaaccgacctttttgagaaataggaacaagggtctgtgaaagacgtcgatatccgtgtgcaatccttttacgcgtacttaatttcggcagaggcgcacgcgcttttgaccgcacggacgtacgtgactacgttgatgctttttcagaaaaaccttgatccgccgtgtaacattgaaagcgccaatgcgcacgattgtgtacgttttatcgaaaagcggagtgctgcgggtgtctcaggcaaaacgattgcgaaggacatggcggcgctgcacgcgttctatcagtttctcattttggagcaggtgcgtcctgataacccaatgcaagacgttgatgcaccgcgtcgtgcgtattcactgccgcgcgtgctgtctcccgaacaggtcaacacttttctgcaatccattccactgtgcacaccaggtggcgtgcgtgatcgcgcgctctttgaacttatttatgctgcaggtttgcgggtcagtgaggcagtttctctttccctttctgacattttttttgcagaacgtctgctaaaagtgacaggtaaggggaacaaagagcgtatggctccctttggagaacaggcgtgttactttctcatgcagtatatacgtgaggcgcgtgttcgttttacgagcgcgaagcatccggagaatagtgaaaaaaaaggagctgtctttttaaacaggcaggggggtcgtctgagtcgtaaaggtatatggaagcgcctgcaggatattgaaatccgctcaggggtggagacgcacgttcatacgtttcgccattcatatgcgacgcatttgcttgcaggcggtgtcgatttacattcggttcagtgtctgctcggccatgcagatattgcaactacccaggtgtacacacacgtggaaaatggacagctcgaagcgtgtcaccgcgcgtgtttttcttcagaaggtcttcgtgatgaaaactaggcggtgtgcgtcatatgtgggcggtgcactgtgcgcggcgttctttttttttcattcctgtaaggagcgtcgcaccgtgcaacgtgttcaggatttagagaaaggagtgccccatccaacctctattgaagaactgcggagggcagtaaagctgcacgaacagcgcctcgagcgtttgcacgcagtgcaggatcaggtgggtgtttggtacaagatgctcgcgttgcgctacttcgatcgtaagatgtatacgcacgcgcttgatgcgtttacccaggccattacctttgctcccgaaaataagcatctttttttttaccaggcgttgtgtgccgcatatgcggctaagtacgtcgctcctattgatcctgagaagaaaatgcagcagcaagctgcttatcgcgcgttagcagtctctgcgtatgtgcgtgcgctctcgttggacgcgcagtattcccacgcgttgtacggtctttctgtattgtatgtatttgaactgaatcagccacagaacgcggttcctcatttgcaaaagctcctcgaattgaaagaaaatacagaagcagctttgttcgttcttgcgcgcgcatactacacacttggacgatatgctcaggcaatagagtgttacgatcgcatccttgtccaaagcagtgactcccatcagagagatcgtgcgcgacagaataaagaattagtcacgaatgtatcgcagcgtgctacgcgtggggaccgtggatgaacacggatactgtactcactgaaacgcacaagattgctcttgcgctctcttactgtcactttttaaaaggtggggagcggttgcgcgtttcaaaagctgtaggttcttttcaggagcttactgcatggaaggtgcgtgattttgagcgtgttgtagaaaggcacatacgcactgcgggtgcgcaactttctgcgttgcctcacctcgttcggcacggtatacaaaccatgcggtgttatcagataaaaatggtgttcaaagacgatgatgcgtttccctcctggttaagagaaataagtgatgtaccgtttgtgctgttctatcggggcactttgccgtgtgcaacccaacctattgtggggatggttggcacacgtactccaaccggtgaaggagttcggaacagtttggccttttccaaggcgtgtgctgaatcgggcattgccattgtttcaggacttgcacgtggaatagacggattctgtcacaaaggagcattagcaggtggtgggtacaccctcgcagtacttgcctgtggtgtagaccagttatatccacgctcaaatagcgcgcttgctgcacggattatagaaaccggaggatgcattctgagtgaatatgcgccatctgagcatgtgatgcgctatcgttttcctgaacgcaataggctcatttcaggtttggcacgatcgctcgttgttatggaagcaccaaagaagtcaggcgcgttgattaccgcattgtgtgccttggaacagggacgtgatgtgtacgtgtatgaacccttgcttgaaagtcttcaaaatgagggaggaagacttctgcatgcagaaggtgcacgcgcgctgacgtgcgtgcaggatatgtttgacgattgggaatacgcatgtacgggtcggacgtaggacagtttcggtaagcatagggggcggaaaacatggaagtgcgtgggctacaaccgaaaaggcagaagacatttgcgcggaagcatttggttattgtggaatctcctgcgaaggcgcagaccatcgaaaaatatctgggaacgcagtacgtggtgcgagcgtccatgggccacgttattgacttgccaaagtctcgtttagctattgatattgagcacgatttccagcctgagtacattacagttcgtggtcgtgcgcagtgtttaaaagagttgcgcaccctatctaagcagtcactgcaagtgtttcttgccagcgatcgtgaccgagagggggaggcgattgcgtaccaccttgcacagtctatccaggcgtattgtgatacgccgatcaaaaggatcgtgtttaatgaaattacaccgcacgcgattagggcggcaattggccatccggttccaatagataccgcaaaggtcaatgcacaaaaggcgcggcgcgtactggaccgtttggtaggataccacctatgtccgctcctgtggcataaggtgaaaaacgggttgtctgcaggacgtgtgcagtcggttgcacttcgtcttatctgtgaacgagaagttgaagtaaagcgctttgttccagaagaatactggacggttgaaggaacgtttgaaaaggataaaaagtcattttctgcactactgatactgattcaagggaaaaaggctgtattcaaaagcaaacaggaggctacaagcgctatcggtcttttttctcagagtgaggcacgagtttctcaaatacgcagttttgaaaaaaatgttcgaccgaagcagccctttactacctctacgttgcagcaatgcgctgccaataggctcgggtttacctcgcgtaaaacgatgcaggttgcgcagcagctctatgaaggcgtatctcttggtacccaccgcgtggggctcattacatatatgcgtacagattcggtgcgcgtttctgaagctgctgtaaaggaagtgcgcgcgtggatagcaacgcatttttctgacgcactgccgggtactcccaatcggtacgctgcaaagggaaagtctcaggacgcacatgaggcgattcgaccaacatatgttgcccacactcctgagcggattaaagcgcaccttacgcgtgatcaaatacgtctgtacacgttgatttgggagcgttttgttgcaagtcagatgacagatgcaagagtgcgcagtttgacgtttgaaattaccgctggcccggcggttttcagtgcaactgaaacgcaggttattgaacagggattctaccgtgtactgaaaatgttatcccccaaagatctctctaaagctgtacttccccctacgaaggaaggtgaggtagttgcactacataacgtgcagtccgtacagcactttacgcagggtcctgttcggtacacggatgcaagtatcgtaaaaatgttggaggaaaagggaattgggcgcccttcaacgtatgcaccgactatttcagtactgctggatcgctattatgtaactcgtattcaaaaacagctaatgccgaccccattgggaaaggtcattagtgatcttctcaccacctattttcatgatgttgttgatgtaagttttaccgcgcgcatggaaagtaaactcgatgaggtggaggaagataaaatcaagtggaattgtgtcattgcggatttctatcctgctttcagcgaaaaggtttcaacggtgatgaaagatcttaacagcatgcgcggtgtgttcgatgagaaaacagatgtggtgtgtagtcagtgtggtgatacgatggtgaaaaaactgggcaggtttggatttttccttgcatgcggaaagtttcctgagtgtagaaatactcagcctgtccctcttgcaaagtgtccgcgtcctgcgtgcgatgggaatatcgtggggaaaaaaacaaggggaagaaaggaattctatggctgcacgcgtttccctgtctgcgattttgtcactcactttaaaccgacctttgcagtgtgtcctcagtgtcgatgctttttggttgaaaaatcaaatcgcagagtcggcacatatactgcgtgtgtaaaccctgagtgtcggtatgtatctcctactcgaaaaaatctttctctgggaaaggaagctgtcttggatggtagccacaggggggcacaggataaaggagcagtgcaacattatgagtaatgagcagtttacccagtatcttgaatatctttttcgggtacgcaggctgtctgcgcatacggtttctgcctatgcgcgcgacttgaatctttttgaacgctggttgcaacacgcgcagagagcgtgcgcgcgcgtaacagtttctgatatgcgtctgtttgtgtgtgagttaggaagacggggactttccgcagcgagtattaaccgagttttgtccgtggtgcgaggtttttatgtgtttgctaaaaaaaaacattggtgcgcggacaatcctgcacgcttagtgaggaatataaaaggtccttcaaagttgcctcgttttatgtttccaccgcaagcaaaggcgttttacaccttaccaagtcgtacggatattttgtggcaggaacgggatgcggcactttttgcgatgttgtattcaacaggatgtcgcgtttcagagatagcggcgctctcattgaaagatgtgcatccgcatcttagttctgcgattgtgcggggaaagggtgatcgggagcggaccgtgtttattgctccgtttgcgcagaattttttgcacgtgtatatgcaggcgcgtgcgcagcgatgtgcgcgctacgcctcttgcacacccgcgctgtttgtgaatcagcggggtcggtcgctttctgtgcgcggaatacagtaccttgttagtcggtacgtgcttttggcccaggacgtgcacgcgctgtctccccacgcgtttcggcacagttttgcttcgacgttgatccgtcggggggctgatgtgcgcgttgcgcaagagttattaggacatgcgagtgtgtctaccacccagcgatatgtgcatgtgacttcagagcaactgcaggacttgtatcaccgtgcgcatccgcgtggatagggggtaggaacggagcgtccaaacgatgcggggaagcgagctgcagagaatgtacaccagtgcgaagtgcttttttctgagacttttttgaagaagactttct

SEQ ID NO: 38 - DNA, 14838 bp, Treponema palladium
gtatcgggcatgcggcgcgcggcgttttgtccattctttgcgctagaaacagagcgaacaatattctgcctacctgaggagagaaaaacgtgaataattccgcactccgtgcgtacctgagtacgcgtgctcctgaccagatacatagtgcttttgttgcgtatttggccaatcttgatttagttgcgcaccagtttccgcagattgcttctgatattgtgcaggagctgatagatcagcggtcgtatgtaaagttaatcgcaagtgagaattacagctctcttgcggtgcaagcggcgatggctaacttgttgactgataaatacgcagaagggttcccccatcatcgctactatggcgggtgtcagaatgttgattctattgagtctgccgccgctgcagaagcatgcgcgctctttggtgctgagcacgcatatgtccagccgcactccggtgcagatgcgaatcttgttgcattctgggctatcctttcgcggcaaattgaaatgccaaccctttcttctcttggtgtcaccgccgctacgcatctgagtgaggaacagtgggaagtactgcgccagaaaatgggtaatcaaaaacttatggggttagattatttttcaggcggtcacctgacccacgggtaccgccaaaatgtttcaggacgaatgtttcgtgtggtgtcctacgcggtggaccgagacacaggactgctcgattacgctgcaatcgaggcacaggcaaagcgggaaagaccacttattttacttgccggatacagcgcgtatcctcgttccattaatttccgcatctttcgggaaattgcagacaaagtgggcgcagtactcatggctgatatggctcactttgctggactggttgcaggcggtgtttttacgggagacgaggatccagtgcgctggtctcatatcgtgaccagtaccacacacaaaacgttgcgcgggccacgcggtgcctttattttgtgtaaaaaagaatttgcagaggcggtggataagggctgtccgcttgtgctcggcggcccgctgccacatgtgatggcagcaaaggcggttgcgtttcgtgaagctcgaaatgctgcttttaaaacctatgcgcacgcagtccgtgataatgcgcgtgcgctggcagatgcctgcatacaacaggggatgcagctgcagacaggggggacggataaccatctgctattgcttgacgtgcgtccgtttggactgacaggtcgtcaggcagagcgcgcgctgatagactgcggagtgacgctcaaccgtaactcgctcccctttgacccaaacggcgcatggctcaccagcggactgcgcatcggaacccccgcggtaacgagccttggaatggggcctgaggaaatgaaaagaatagcgcgcctgatcgcgcgcgtgctcggcgctgcaacgcctgtgcggacaaagacaggtgcgctaagcaaatcggcggccgaggtgcccggcgaggttagaagctcagtctgctcggaagtgcgggagctgctcgcacgcttcacgttgtaccctgaactcgacgaacccttcttgcgcgcacactttacgcgtcgccctgcgggacaaaacacctgccgacgaagggacttgaacccttacggggttaccccaacagattttgagtctgtcgtgtctgccagtttcaccacgtcggcccgcgcgcagcctatcacacgaggaacaaaaggtacagctgttcatgtagtcttcttgcgtgaggccccgtgtctcccattgagggagccgttatttttctcccatgaggagttttagttcccgaatatctgccaccagtttagagcgatctaaatgctgataacgcgcagggagcatttcctttcctgtgcattcgagtactgccactaaattttgcagttcaatttcgtgcggataagcaggagggataaagtcttcaatggtgcgggtgatgtcctgtgtggttaccatcgtgcgattttccatcgcagcagttagctgggcgcgtactaaaatggcttctaagtccgaaccggaaacagcgaattttattctgcgaatgattgccggtacgtgtacatctttgagcttgatacgtaatttttttttgagtgcttcaaaaatttccgttttttcttttgtggtttcagggtagaagagcgcaagatgctcttctgcgcgtccctgtcgtttcagatctattggtagcaagtctgggcgcgaagtaatcaggaaccaaataatattgccccggtgttgggtgttacccataaaccctgcaatttgtgcaaaaatacgcgattcacctgccggcgcgttacgcctaccaaacaccgcatcagcttcgtccaccatcaccgctaccggggtaagcgctttgaggatgttgagcgttttttctaggttcgactgtgtaatgccaggctgcgttgcctggaaattacacaaacgcaccatgggaatcccaatttcccccgcaaatgcggaaaccataaatgatttgcctgtcccaatcggccctgagataaggtatcccattggcaacacatctgctcttccttgcttaatggcgcgcactgcgttatacaatctcttttttacaaagacatttcctgcaacgtatgaaaggtcgcaggatgtgtcgacaaattccaacaaaccgcctgcttcgtgctcaataatttcctgtttcttcctttttagaaattgtaaggttgcagagtccgtatgggaaagtctactgatattgtcctctggcttcccatttgcatcgatcgtttggtacgtctctgccgcaagctggtggaggttcactaaattcaaaccggaagtgagtttgccaattttctccgtattcaacccacgttcaagtactaaaatctcctcctgggttttgagatattcaagaaagcgtatccgtgtttcttcatttggcaggggtatgtgaatcttaacggtggaaggagaagcggtgaaccgactgttgatgtcagtgatattctccgtgagcatcacaacggatatgtcttcgtttgtgaacaccggatcatttgcccagcgattgagggtgacgaagcaatagcgatctgtttcgcttaagtttgcaatatcttctgagggaacgagagattcagaatagtcgatgatgaggaccatacgcttattctgtttcatgttcataataaagtagcgctcaaggtacgcaaaagctttcaccggatcacgcgaaagaaagtcagcaagtgcctcagtaggatactgggcatgcatacgctctaagtaagcgctcagcatttcttgtagacaaaatgtgagccctgcagatttgtcatagaagacgatgatatcccggttaccgaagataacctcagatatgtagtcattaatgcgaacgaaggagaagctgccctgaatatcgcgatgggggaggaagtcacggatattgccatgtacgaagtacagattgaccgttttagagcaatacttcttggacaactcctgcgcccaggggggaagaccgctgataataatactgttcttttcaagtaattgctgccccgaatgcaccctacccctccgaggggcgagtgtagcgcgtatagaacagaaaaatcaacgaggtagggaggaaagcggatgatgggagtcgaacccacgtctccagcttggaaggctggggtaatagccgttatacaacatccgccggacgggcgcatgctagcgcagcacccgaggtggtgtcaagatcacctgggaatataaatatagaacgaaaggcaagcgacgggaggatcccctatattgagtaggttcctgcaatggtatcaccgccggtgcctgtccagtttgtgtgaaaaaactctcctctcggcgcatctgtgcgctcgtaggtgtgcgcaccaaaataatctcgctgtgcctgaaggaggttggccggcaaagcagcaccggtgaacccatcaaaccaggctaacgcagcagagagggccggaactggcaacgcctgccgtaccgattctgccactatggtgcgccagcctggacacgcacgctttaattcctctgcgaaaaagggagcaagtaccaaattctctagatcgtgctgctgagcaaacgccgcactgatcttggacaggaatcctgaacgaataatacacccgccacgccacagcgatgcaatccgggaaaaatccagtgtccatcctcggcgctttgccgtatgcgataacagctcaaaaccctgcgcatacgagactattttcgcgcaatacagcgcgtcttccagtgcagacaccagttcttcgcgctgctgtgcacttagcgtttctgctttggagactttcacgggagaaccaaaaacgcgatgtgccttgcagcgcgcttgcttttgcgcagaaagactacgcgccatcactgactctgtgatcagtgtaagcgggctgccttcttcgagcgctgcaacacacgtccacctgcccgtccccttctgtccagcggcatctagaattttctctaaaagtggtgtgccgtctgtgtcctgatgtgccagaatagccgcggtaatctcaatcaggtacgagtgtaagcggcccgtgttccagcgggtaaacgtatggtgcatgtgctcatagctcatgcccagcgcatgcttcataaaccagtagccctcggcgattatctgcatgtcgccgtactcaatgccgttgtgaatcattttcacgtagtgcccggcgccatcactgccgacccagtcgcagcacggggtgccatcgtcggctttggcggcaatggcacagaaaatgggagaaaccaacggccaagcctgagcagagcctccaggcatgagggacggtccacggagggccccctcttctccccccgaaactcctgtgccaatgaaatgaatacctgcggcctctagcgcatgcatgcgccggatggtatcctggtaatgagagttgccaccgtcgataacgaggtcccccttttctagaaggggcagtatctggtcaatgaccgcatcgactgcgctgcctgctttgaccatgagcatgattttgcgtggacgtgccaaaagtgaaacaagttctgcaatggagtgggcgccggtgattcgcttgccatgagcgcgccctgcaagaaatcggtcgaccaccgtggtggtgcgattgaaaactgcgacggaaaaaccgttgcgctcaatgttgagaaccagattctctcccatgacagcaagtccaatgaacccaatgtctgcgcccatgcgtgcctcctctgcgtgcgggccgagtgtagcgcgtttagatactttttgaaaggagatggggacctggtgctgtcagtgtacatccgcgttctttgtgtctttctagagcctgtacagaggggttcctgcagtctttaattgacttttattgcacgttgtgctctgcttgccccctatgagaagacggaggcgctttctcactctttgcgcgtgtgctgtgcaccttcttcctcttttccctcagacgattacaaccgcttctgtctttttcgcctcagtttctgagcattatgcccggttaaaggattacgctgctgatttggccatgagcaccgggtcaggaacccgcgcgcaccttatgcgcgcaaaggttatttttaaatatccagaccgtctgcgtttggatttctcaagccctgctgaacaaactattgtcttcacgggagatagcctgaccatctacttgcccacctcccgcgtcgcgcttgtacaatcggtagcaaaagatgacacagtaagtgctgcttctctagcttcgcctcatggtcttgcgcttatgaagcggttctacacgatagcctacgagacgagttcttctcctgttcccctgggtccggacagtggggagatggtcgttgcactggtgctcaatcgtaagtctgcagcagaaacatttaaatctttgcgcgtgcttgtctcggcacataccaagcttatccgtcgcattgaagcgtggcctctttcgggggaaaaaataacatttgatttcagccactatcgtttgaacgtcggtattccagacacacggttcctctacgatgtgcccccaaccgcaaatgtggtgcacaattttctctttgctgattgaccgctgcccccaaaggacgtgacgatgccagatattggagagctgctaaagacgacgcgcgaacgcaaacacctcagtctcgaacaggctgcgcacgagacgagtatcgcacgccgttacctggaggcgctcgagaacgatgagtatgatgtttttcccggcgaaccctacatccttggctttttgcgcaattactgcgagtacctccagctggatacggagcagtgcatcgctcgctataaacatttaaaaattcaagaaatgtcgctgccaacggagaccctcctaccgagtaaacggtggggttcatttcccctgttaaagggagttgcctgtgtgctcttcctgggtggggtgctgggtgtgtattacgcgcggcaccgcgcgctgggttttctatcccgtattgtgttctttggcagagcacagcgtaccccaagggagctgtctccccccgatgcaacgggggcggtgcgcgaaacagtgtcgctgtcttctgcacaacatgaggagcgtgcgcgacgcacgcgttcgagcgcatctcgctatacgcttgctgaggaaaagtttgaacacacggtctttccaggagatgtgttggttatcagttccggggggaatgcgtacgagctaaccgtcagccgcactacgccgcacctgtatctggacacgcccattggtacacaggtgatctctcttggtcagcgcctagtgatggatttgaatacagatgtgcagccggacgtagaaataagtgtggaagacattgaagcacatcaggcggacgggggcgcgcgtgttcgcgtgtttacaggtagtctggtgcagacgctccgtgatcgcagtgctcagagctttgtgcctacaagtggggtaaatgtctctggtcagacgggagtcgctgccggcgcgcgatatcaagttttgtttgaaggcggtgttgcgtacccggtgacaatgaacgcaacgtttcgctcgtactgtttgttccggtacgaagcagatcgcacgcggcgggaggagcggtattaccaaaagggcgagcagctgacggtgcaagcaaacaacgggattcgggtgtgggcatctaacgggaatgtggtgcagctgcaaattgtcgcaggcggtaagacggtggatgtaggcctcagccgtccgggggaagtgctggtcaaagacatcaaatggatcaaagatgaggacgccgggcggttcaagttcgtggtcatggaagtagactagcgcgcggcggcagcaatcgcgtacgcgttccagagcgcgtggactgcagtgcacagtgcgcttgcgcgcgcgcgggagccgcttctttttttctctcttacaaaaagtacccgtagcgctgcgcccgcagctcctgcaaacagcgtggcgctgcctgcgggccggtgtgcaagagcaaagagaaggactgacagtacctcgccacaggcgcgtgcagtgcaggaagtggcatggtggcacagacgctcaggtatataggcgcgaaagagcacttcttcgctcagagcatttaaaaaaagccgtacataaaaagctcccccttccccttctgggaagggaaacggtgagggaagagaaaaacagaaggaaggaaatactagcgtgctgagtacgaacgcgtattcggtaacagccgccgcagcgtgcagtacgtgtggcgtgttgcgcaaaggggagaggtgcatcagcgtggaacagtgtaacagaatcgggcagagggggtacagagcgcatatatcccctgcagtggtgatggccattgctgcggtgggaggtttttatgggactcacgtgtatgaggtaccgtttccgtatgcattctttggtgcagtacaggcgtgtgtgctgtgtattgggtgtttgttggtccgcagtggtgtgcggttcttttctcgttggggtgctgtccgtatctggaggaggtggggaatcgcatacaccagcgtatgtcggtgttgtaatacgctttttttcgtgttctgtggtctgtgtgttgcctgcgttgcgcgaacctccctcatggtacaacaagctccgttgcaaacacttgcacaaccccaaaaactacgcgttttgactatacaccttttgcaagagccaaagcctgcaggcacgcgctttcgtgttcgggcgcgcgtattgggtgcaggttacatagacggtgcttccttttctgcacgtggggtgtgcactgtattatttcctgcagaggtaattttgcagcagtacgctaccgatatgacggacgacgcggatgcccgcgtctgtcagtattacgcgcgtgggttgcgctgtcagattcgtgggcgctttgcatcttctgcaccgaagctttttatcagtagttctacaccaccacgctttgttggctggagttcctattttgcacagatgcgcgcacagatgcgggttgcactcatgaggtttttatctccatgggggcgtgcagggggattgttactcgcgctcctttctgcagatagtgtttttctttcggatgaaatgcgtgtcgcgtttcgccatgcaggacttgctcacgtgttggcactctctggcatgcacttgtctttggtaggggcgagtgcaacgtttttgggccgtttcatcggcacaaggcacagaggtatgcagggggcgttttttgcgatgcttgtctttgtgtggtttgcaggtatatcgccttcccttgcgcgtgcacttggtatgactttagtgctgatgggaggacagatggcatacgtgcgcgtaggacttttttctgtactgtgtgctgtacttagcatacatatgctcattgcgccgcatgatgtacagacgttaagtttcatgttgtcatacggagcgcttgcaggtattgtgttgcttggctctgagattactgaaatgatgtcgggtttgattcctcggccacttgcatcgctgcttggaacgtcctgtagtgcgcagttttttacagcaccgatagtgctttcggtcattggatattttgcccccattggggtacttgcctcgtgtgtggttagtccgcttatcgccttatttttgataggggggagcgtggcgctgtgctgctctttggcagtgcctgctgttgcgccttttttaagttggggtgtgtacttttttggtgaaggactctgtgcggttgtgcgtttttttgcgtgtgcgccgcttgtgtatgtacagagtgcctgcggacatgtgtgtgctgcattattttcttttttactcggtgggggactactagaggcggcgcgtcgcgtgcgtgttcacaaggatacatatgtgttgcccgaattataattcggcgcgtgcacttgcacagtttttgacggagcgcggtttgcggatgcataaaaagtgggggcagaattttctgctcgatccggtgttacgtacgcagcttgttaagatattggcgccggagcgtggggaacgtgtatgggaaattggtgcaggcattggtgcgatgaccgcacttttggtgcaaaacagtgattttttaacagtgtttgaaattgatcgcggctttgtgcagacattgcgcaaactttttgatgcacacgtccgtgtgatagaaggggatgtgttgcaacagtggcatgctgcagcagcacaggaacaacctgcgtgtgttctaggaaatttaccctacaatattgctgcccgttttattggaaacacgatcgaatcaggctatatttttaagcgtatggtggtgaccgttcaaaaagaaatcgggttgagaatgactgcgctccctgcacaaaaatggtattcatacttttcagtactctgtcagtggcagtatgaagtgcgtgtgattcgtaacgttgcgcctgtctgtttttggccgcgtcctcatgtagtttctcaagcattggtactcaccaagcgtaatgcggtgccttcttgtgtggatcctgcgctttttctgcacgtgacgaaaactttgttttctgcgcggcgtaaaacggtaagaaataatttactcacgtggcaaaaaaggatgccaggcggtgcagctgtgtgtgtagaagaactctgcgcacgtgcaggtattgacgcgcgtgcgcgtgcagagcaactgagcatctatgattttattacgctttctgatacgctgcgcgcgctactgtagtccggtgtgggtgttgaatggcgcgtgtctatattctttttttcagtgtgttttttgtttttccgctcttttctgaagacgccgcgcgcgatgtggaacctagcgatgcgcctgtgccctatgaggacacagaattttccttatggcagaaagaattgtatcgttttgaagcgctgtccatcggtgcattcccgatagtaacgctgctctcttttatcacgtatgacatcatacgtcttattcagcaatggtcgacaaagcctccgacatggtgggcgctgattattcctggcgcggagctaccgccactgagtacgaaggagcgcgcgatagtttttggtgtggcagtggggatttctgtgacgattggattaattgacgtgacgtatcgtgcagtgaagcgtgcaatacaccggcgtagtcttgagcgttcgcagttagtaccagacccgatagaactggtgccacttgattcttttgttgaggggactgacgatagcacgtgaaggtgcacagggtgtcgtattcttgcagtgcagaaagcacgtcggtgtgcagtgttcatttttccgtttttagaataccgggcgcgacgtgtcggtgtgatgtgttctgcgcagaacatgtttttttttgtgcacgatctcagctcaagaggatcgtgcgtgcattgtgtgtgaatgggcatacggcaaagttttcaagacctcttcacgtgcgcgatcgggtgtcttttgagtgggtacgctcagtgcccccggcgctcattcctgagaatatatcgctttctattctgtttgaaaacgaagacattattgcggtgaacaaagcgcagggcatgatagtacatcctggggcaggccactggacgggaacacttgttcaggcgctcagtttctaccgggtgtatcgtgcacgttttgaggatgagttttctcgtcaatttcagaaaggatttcccgattttttcagtaccctgcgtcagggtattgtgcaccgtttggataaagatacatcgggcgtactcctcacttcgcgcaacatgcatgctcatgaggcacttgtacgttcgtttaaaaaaagacaagtaagaaaagtatatcttgcgttattgcagggtgttcctgcacgcggggttggggtgattgaaacaacaatcgtgcgagatagaagacgacgcacgcggtttgttgcgtctgaagatttttcaaaaggaaagtacgcacgtacgcgatacaaggtgatgaaaatatgtggggcgtgcgcttttgtccagtttctattggatactggtcgtacccatcagatacgtgtgcacgcgcgatacctaggatgtcccgttgtaggagatccgttgtatggttcccggaatatctgtggcatacccacaacactcatgcttcatgcgtacgcagtacggtttgttcttccgagaacgaaaaaacgcataacgctggtagcgcccataccgcttcgttttgttcgactgatacaccgattatcggttaggtagggtgtggcaggtgcgtgcgtatatgcgttttacttcagcagctaaatagaaagaaccgatggcaaggagcgctttacgttgcgcaaaactggcatacagtgcacgggaaataattgacgcaaagtcttcgctccaaaaaattgggactgtttggtgaaatgtcgtacgaaacgcgtggtatgttttttgtatatctgcatgtttagatgtgcccggtatggttaaaaaaatttcgctggcggcatgtgaaaaaagaggggggaactgggacactgctttgtccgccgcgcacgcaaagagtaaaatgtattgtgcagaaggtagtaaagaagagaacgtacgacatgcgcaccgtatactctgcgtagtgtgcgcaccgtcaatcactatgagtggatcttcctgcataatttcaaagcgtgctggcacgtatgcacgggacagtccccgctcgattaacgtttcgctcacggtaggaaataaatattttgccgcgcacgcagccagtgctgcattttttgcctgaacaatatcgcataacgcgagtgtgcagtgtatatttcgagcgaataatctgccaacaggatgcgcggcgttaaaactgagagttgcagtgtgtgtgaagtgttttattgaactttcaatatgtgtgaccatatctggtaagtaaaagaagggagcatgtttttctcgcgcgatatgtttaaaaacgtgcaatgcatcttctggctgatcaaaacaaaaaataggcgtatagggtttgataatgccgcccttttcttttgcaatactttttatacgtgttcctaatatgcgcgtgtgttcttgttctatggggagaaggagacagatactaggacaaatgatgtttgttgcatctagtcttcctccaagtcctacttcaaaaacggaccattccatgcgttgttgtgcaaatagcatgaacgccagtagcgttataagctcaaaccacgtcgcctggccgtagtcgcgcagattctctgtttttttcaccgtgtggtatacgtgtgtgcacgcgcttgcatactcggcaggtgaaaaaaacacacccgcgcgtgttattctctctctcggatccataacgtgaggagaagcgtatagcccggtgttgaatccaatttcattgagtatcgctgcaagcatacgtgcgctggaaccttttcccttcgtgcccgcaacatggatgctctgatatgcgttgtgtggattacaaagcgcgcgtgcaagtgcagtcatcctgtgcagaggtggtgtgccgcttgggggcattttctcaagcgtgcgaatgcgctcaacccaggcgtaaaaatcttgaaaagaatgcaccggtatatgtgaaactccgtgtgcgctcggtcgcactataatatgcggtacggaagaggcagcaatccttgccgggaaagagaactgatgtacattgctaaggtctgacatttgagctaaaatccgcccatgaagcgggggactctaccaaaagatgtgtcaggtatcaagattcacatgattggtatcaagggcactggcatgtctgcgcttgcagagctactgtgtgcacggggtgcccgtgtgtcaggtagtgatgttgcagatgtgttttacacggataggattctcgcccgtttgggtgttcccgtgcgtactcccttttcttgccagaaccttgctgacgctcccgatgtggttatccactctgcagcctatgtgcctgaagaaaacgacgagttggcagaggcgtaccggcggggtattcctacccttacctacccagaagcgctgggggacatttcctgtgcgcggttttcgtgtggtattgcaggtgttcatggaaagacgaccacgaccgcgatgattgctcaaatggtaaaggagctgcgccttgatgcgtccgtccttgtggggagcgctgtttcgggaaacaatgattcttgtgtggttcttaacggagataccttttttatcgcagaaacgtgcgagtaccgtcggcatttcctgcattttcatcctcaaaagattgtcctcaccagtgttgagcacgatcaccaggattattactcctcgtacgaggatatactcgcggcatactttcattacatagataggcttcctcaatttggtgagttattttattgcgtggatgaccagggcgtgcgggaggtagtgcagcttgcgtttttcagtagaccggacctggtgtatgttccttatggggaacgtgcgtggggcgattatggggtcagtattcacggtgttcaagaccggaagataagcttctcattgcggggttttgcaggtgagttttatgttgcgctccccggtgagcatagtgttttgaatgcaaccggtgcgctcgcattagcactgagtttagtgaagaagcagtatggagaggttaccgttgagcacctcaccgctctgcggaaggtactcgctctttttcagggatgccggcgaaggagtgaagttcttggggaagtgcgcggtattttgttcatggacgattatggacatcatccgactgcaattaaaaagacgctccgcgggttaaaaacgttctttccggaaagaagaattgtcgtcgattttatgtcccatacatattcgcgtaccgcagccctcctcaccgaatttgctgagtcttttcaggatgcggatgtagttattttgcatgagatttacgcctctgctcgggaagtgtatcagggcgaggtgaacggtgaacatctttttgaattaactaaacggaagcaccggcgggtgtattattacgaggctgtcatgcaggcagtgccttttttgcaggctgaattgaaagagggcgacctgttcgttacgctcggcgctggagacaattgcaaattgggtgaggtgttgttcaattattttaaagaggaggtgtaaagttcggttgcggtttcgccaacatggtggtggtgccggctgtggatctggtggatatagggtgaagtgagacaggctgcgaatggatgg

SEQ ID NO: 39 - DNA, 21636 bp, Treponema palladium
aacatccgcccgtgtacgagaggtagtttgaccagacgtcaccggtgaacgcacagcctgctcactagcaacacgggaagtgtctttaggcgtattgtctcgtagggtcatagctctcctattcctcgttctcttcgtattcaaactcaaagctgaggccaataccacagtgaggacactcactcatgtcagtagtaatgcgcaccccacactcaggacactgcaacgcctgatcctcatcaccaccagtcccgggagaagatgtaactgaagcctcctccccctcctcgacaacttcaaaattctcctcaatggcggcgagcaattcttgtacgtgcgcctcgtccatgccctcaagcgcacgcaagccttcctcgcccaaatctaccaaagtctgtacgtcttggataccgttgtcctgcagaatcttaatgagctccggcgtaaatcccacgtatgaagaaaactcagactcttcttgataatcgttatcaaaaagattttctgccgcacgacgcgtgtcagtgtacacatccatctcttcaaactgactctctgtcttcacatcgatattccagtccacaagccgattcgctaaacgcacgttcaaaccttgctttcctatcgcgatagacagctggctttcagcaacaatggcaagtgcagaacgcttctcctcatcaagtaccacgacgttcagcacctcagcaggagaaagcgcatttttgatgaaaataactggatccggagaatactcaagcacatctatcttctcgtcattcaattctttaataaccatgcggatgcgtatgccccgaggacctacgcaggcaccaacaggatccacatcatcacgcctactggtgacggcgatctttgtacggtaccctggctcccgcactatttttgccacctcaacaataccgtcgtagatctccggcacctccacggcgagcagctcttttacaaaagcagagtcagttcgtgaaagaatgagctggacaacgctcgactttggatgtttgcgcacctcacgcacaagcgacttaatgcggtcgttttgacgataatcatcctggggcagctggtgcgactttggcatcaggccctcaacttttcctaggtcaacgtagatatgctcgtttcgcgcgcgttggtagtagccaacgataatctctccttctttgctcttgtactcagcatacagagcgtccttttgaatttctctgctcagctcagtgatacgctggacggcagcctgcacagatccacgcttaaaatcttcggactcaagctccaccagcacttcgctatctaaagaagtagtgggatcaagctcaagtgccgtagacaaatccacttccgagacgcggtcgtacacctcttcaaccacgcgcttgcgcgcatagatacacacccgctcctcaccaaaggtaacgacggcgttttcatctgtcttaaatgtagtcttataagcggccttcagtgtttgctcgacgattttaaaggcaaagtcttcatcaagccccttctcctgcgcatactttctaatgtcatcgttactgacgccgaacataggcggctccttaggcgattttgggcgaaggtgcagaccaaaagccctttcaagcgcggactgcaggatgtaactgcgcttttgttagctgaacatacgggatagtaacgggcactccgccggcggtcagggtaaggcaagtctcatccgcaaacgcaagagtcccaacctgaaactgccccgtgcaaaaccagaccttcacagtctcccctaaaaagatggaaaactccgcggcgttgcgaataacccgctccccgggggagccgacttcaagaaaaacagtgcgcacaccaccgagagcctgaaggcgcggcaccagtattcgatgaacgcgcgcgcacacgtcgagcgtcactccccctgcgctgtaaataacggcacgcgcccttccctgagcctgctgcacacgccgagaaacagcggaaacgctccactgcagatcgacaagggcacacccgagcgacctcacaacctcagcgcagctttcaaaggatcccagcgtattaggactgaagttcacgcacgcacccctcgcggggctcactctagcatgtttaaaactctcacacaagggcccacaaaaatgaggatacgcccgctacacactacgcgggcctcggttactgtgagggtgctaacgcactcgggcggcacctccgcaccacgccggtgcacgttacagactgcccgtctgctagccggccacccgtttcaccacgagtacgtcggcagcgcgcccgtgacgctcttcatcacttttaccctgatcgttgggcatacgaaacacagagaagctgaccgttgtaccttcaggcaaggcagtagcacgacactcacgcttgagattgctgtacacaaaacgaaaatcaccaagctcttcatgactgataacaccccaccgatcacgctcacgaaaacgcttgataacaccgtagagcaccgtgcgcttgtgggcaccacgcactgcacgcacccaataattgggagggatacgtcggtcagactgcacctcaaaaagctcaggaagagcctccaccatttcccgcagggtactatgattgtaagaacgagggtcgaactcaggttttgtgatgcgcagcgactttcctaaatttgaaaggctcacccagccttcttcggtcatgcgcgagtttctgtaagcgtgcgcaatgagcttccctaagtcaaaacccccagtatcctcttcaacggcatcgacccctgcaccaggaactgcagcagcatctgactcagtatgaaacgcaaaccccgcgctcaggccaaagtgctcagtttcaatattttcgatgtacttaaattcgttgcacgcagaaacccaaatctcacgcgcgtttcgttttccaataccgagcacgtacagaccgtactcccgcagcttgagcgcaagactgtaataatcagaatcggtagaagcgatgcacacggcgttgatagcccggttattgttcgcgagctctatagcctccatgatgatggtattatcagtggcgttatccccgtaccgaaactgctgcactggtcggataggaattttcgtgagcagccccttccacccattcatgttaggggtagtccagtcaccgtagacacggcgaacgtggatatcaccttctttagacacttcaccgacgattccctcaaggaatttaggggagatattgtctccatcgatgagcaacgcaaatttcttttccaaaacgtcctactctgcaagggttttcttgacgatggattctactaactcgatggcctgatccatatcagaaagctctacatagctatccatcagtccacgcgtattgtggaacgacacgcgcgtcttcccgcgcacatcggtaaccataaggtacagagggacacgaagaagaaagtaaggatcctcgagcatgaggggcgtgccaattttagggaagcccaccaccataagctttgcaggttgtatatccaagttctgtttgtgggctgcctcgcggtagtcaacaataccaaaaacgctaaagccctgcgtgcgcaaagcgctctccaaaagctgcatagtgcgatcgaaggggtagcggctggtgatcgtcatacgcacccccggccgcgtgttggaggttgacccggctgcgcttgaagtgcaggcaacaagccctcctaaaaggagcactcccagggaagcaacctttccccacacgcgccacctgtgatggcacaaacgtctacacaccccgcctacctccgctgcgtgtcatgcccggccagatatgcgccggcgcaaaaattccacgtatcgggtcatatgtgacccgatacgtggaatttttgcataccttccgaaggggcgtaaattcgccccttcggaaagaaaagaaccatacatccctaccaaatcaagcgacatgcccctacgaattgccaacgctccgtcacgttcttctctatcactacattgctgttctcttgtagcttgccttgctcccagctcagccgaatctccaccttctctaacggactgaccactaccccacactcgtaatacccacaatatcctgccttccacttcgtagcaggagcagcagggggcgtggcctttttgttcgtaccgccgtacaagtttgcatacactttaacccaaccatactcacccatatcatgacgatacgaaccccagacttttccatacaccgggaagtrratggctgggggtagggcttttaggactttgtaatggacaggcatgtacgtacgcacatcaacacccaaatcaagaccctcaaggaaagaagtatcaggatcagaccccttggtttcgagcttaatataggcagcacagtcgtgctctcgcatggccatgttgagaaatactcccccgaatacattgctggcctkcgatgcgaaatatcctcccgccgagaaccaacgataccccaacgtcaacaacgcatctgcgcctacggtgccctgcgctccgtttttcttatgccccacgtctgtagcagccagagcacacagaccccaaagcttcatactcaccttagccccggctgccagggctcgggcttgggcatagtcgctagacagtgtggagttgccggtgagctccactttaatgtattcctgcacgccatcttcacgcgtacgctcccagccgaacaaaatatctccccccaatccatacttgctgggggttactcctgctgggacgttgcccttgctgtctttgccctcccagtcggtgttagacgcaaacttaaacgcaatatcaaacgtgagccccgtgccggcgatgtcagtctgtttataccctaactttcccccggctccctcaaaccccggctcatacaccggcttatctcccttagacttataatccccattcgcggtccacggctcccacaaaacagcaaacgttgacttaaaatcaggattcttcccaatggtcaggtaggccccataacagtgcagggttgcctctatcgtctttgcagaacccttcgtgtcaaactttgctccaccatttgactctaaactcaacttcaacgctttaacattaatttccgcatagacattcccctcaccgcggtacttgaaatccttctttgccacaatggggaacacaatcttaaaatcagtagtagtcttaaatccatgcttgaggtttccggcgcyaccatyttcrkatgcaatgccccaggccagctccgcatagccttcaatatccggggtgaacgaaacctgagcccacagccgcggggaccgccccagaaccacaacgaaaaagaaaatgagagaaaatcgcctgtgccctacccgctgatacaccacttttctccgatgccgaaaaccattactaactaaacgtggggaaccataccgggaagtggcagatgggtcaatcattcagaatccggaactgcgttttttttcagaaaatgagattctaacgcttccaaagaaaattcatgcccggttcggaggtaatacagaaaggccgtcaccgggtggtccgagaagagatcctgcaccgcccgtgcatagtgctgcaactgggggagataacgcgccgggtgctcttcgtaatcggttttgtagtccacaaggtgccacaccccattggaaaggaagaggagatcaatggtgccggcttggtactccgctccatgtgggggtttcgtattacctggagcgcgggtgagaaaggaaaactccgcaaaacgctggtgagcgggggctgcacatgcacggcagcccaagggggagtgaagaaagcaggccacaaggcgtgccgcaggggaatcaacacgttgtacgctatggagtgcaacggtcggcgccggggactggaaaacctgcgccaaaagctcatgcacgtgcgtgccaaactccacgccacggggggactgcggggtcaagggcgaaggagaagcggaagccgagttttgccccggagccggagaaaccagggacgtcaccggctgaacaagacggggataataatggggtgcgcgaacaggcactgcagcgtaccaatcccgaggggcggatgcttgcggcacgctttggcgagctgacccggtgagggcgcgctgatacgcctgagggcgcgccagcggcagacactcatcaaacgacaccggtgcgggcaccacagagggagaaggatggggaggaaggggggctgcatgcataagcgcagggagcagctctgaaaagaaagagagggaggaaggaggctcactcccgtcaccagaggggagcagagagcagatgtccgccaacgaccgagaaacggcaggagcaggatgtccgtcagaaataggcagtaccccgctgacaatcacgtggcactcagcccgcgtgaaagccacatagagcacgcgtcgcagctccgcgcggtacgcccgggcgcgcgtgtcttgttcctgcacaaagatcggatgcaccccctcagggtgaggcaaaaatcggggaatgtatccgtacggggagtgtaccgcgcctacgcgcgccatcactcgcggtccagaactccccgcgtccggcacacacacaattggaaactcaagccccttgcttttgtgcacgctcataatctgcactgccccacacgcgcggtccgtgcaaggcagctccagctcctctacccgctcctgggcagacagacacgcatctacaaaatctaaaaattctcctatcccctttccctgccgatctgcccgccgcgcaagctcaaacgcatagtcgtatatcacatggtacggacgcgccagggggtcttgcgcaagcagcgttccatacgcctcggtgtaccacagataggtcagcagctcggtattcgtcgccaggcgccgcacctgctgctgcacgcgcgcaaaaaagtccgcgcctgcacgtacacaccgcgccgcaggcgccgataactccgcggggatatacgaaaaaggggcgtcggggggtgcgggtgggagcagcaacagagaaagcgtgtcgtcatcgacccgtacaaacggaccgcggagcacttgcgcgtacacatgccgatcggcaggctcgagcactaaacgcagcggggcaaggagatcagacagcggcgcatcgcaaaacataccccgcgtttgaagcgacgtgtacggaataccccacagacgcagcgcgcgctcgtaccgcgcctgcttgtctgcagaacgcaacagaatcactacgtccgcccacgtgcacgcgcgcggcgcctcccccttgtggcgcaccagggtgccgccgtccaccatggcacggatagcacgcgcaagcgcccacgcttctgtctcctgcgccgatagagaatcctccgagtcctcagacgcgcctgtcctccctgcttgaggagttgggcgcgccgctgagtgctgcgcttcgtgctccggtctggagaaacggtgacgatccactccaatcacccgaaactgcggctcaataccggcagtacaccgggccggctgcatatactgaaacccaacctcgtacccgttctcggcagactcagacggcccacgcaaaatatgtgaaaacagtatgttgaggcgctcaaggagcgccgcttctgttcggtaattgatacgcaacgtctgaagtgtgggctgcagctccgcagcagcggaaagaggaagctcctgctgggacgcgccactgacctgcggggtgagtacgcctgccagagaccgaaatacccgcacatccgcaccccggaacgcataaatcgactgcttttcatctcccacaaaaaacaacttgtgtgcgcacaacgcatgtgcaggagggaggaagtgcgcggtgcgcgcttcgtgctcggcaagaaaaaaaagaagttccttctggagggcattgttatcttgaaactcgtcaatcatgaacgcatcgataccccgcttgtaagaaacgcgtatttccggatactgacgtaacacctgcaccgcaagatgcgccacatcggcgtgactgagacaattccgttcccgtttttgccggataaaacgcgcctgcagaagctcgagcaacgagctgagtgccacaaggaacggtacctgcgcaaaaaacgcgtgcagccgttccatttgcggtacaagttgaagacgcagctgctttacctgtgcttttatcgcctgtgctgcacccgcgcgcccccctaaattacccttcagacaaaaaagcgtttttaccgccgcacaataccgcaggcaatcgtgtgcagcgcgccgcgctccctcatcagggtcagacacagaaaactcatcaggtttagctgcatattcctcgtacccacgtgccaaaaacgcgtcggcaatcgcatctgcttctgcagccggcgtgtaggaaaaggcagtatcctgtgccgcaaacagcgcaacgcagcgcgcaatgagcgcattctgcgcatctgcctcttgcatatggtgccgaatggcgtgcaatgctgcgtgtatatcgcagagcaccgtttttaataacccacgcgctgtagcaatttgatgcgcaagccctgcacgaaagtcacagggatgtgtaagtatgccgtgatcctgcaagggaataaaaaaaagttctcgcacgcagtcttcggcgtgctcctgctgcaaaaaatgcagtaccactggatgttcccgatgctcaagaaaaaaatcttctgcacactcgtgtgccagcgcgcggttctcttcctcactgagagaaaaatcaggcgcgataccgaaaaagcgcgcgcctacccgcgcaatttcgtgcgaaaaggcatctaacgtcataatgcgcgcttccccaaaccgcgcaagcgcctcacgcgcacgcagcagatacgcttcgtgccccggctccggctgcgcagacgcactctgtacacacagacggaggtcctcataaattctgcgcgccatttccatggccgcctttctggtaaaggtgagcaccacaatccgttcaaccggaattgcccgctccacaaccaggtgtatataccgcgcgctaataaccttcgtcttacccgaacctgcacctgcggtaacaactgcattatgcgaagaaaaaactgcacgccgctgctctgcattcaaactttgaaaaaaagaaaaaagaaaatcagtcacgacgccccacgcaccacatacgaggtacgacacaccggcgcaaaacgacacgaggcacattcaagccaggtgacatacggcgctttggcaaagcattcctggcgcaccgccttcgaaaaaactgccactgactgctcaaagcgctgcataaccgcctgaaattgtacggtatctaccccacgctttgcacccatatccacccgcccgttcgaaacaataaccttaaaatctctctttctcacgtctaaaaaaaaagcgtgcgtcacggtataccccgcctgctccaacagatacacatacataggtatttgaaaatcagacaaccgacctttcttttcacaatctgtgtaatcagaaagcgcagggagcgccccggtcttgtaatctaacactgcaagcgaccgcgcgtccggactgcacgaaatgcgatccaccaaccccgtgtagaaacactgcgtatcggtaaactcaaacgctttctcagtacgtaccacgcgccagccgtcaagccgctgcgcatcaaactgcaatacaaactccaccatgtgccggatgcgcgcgctcaggccgcgcgcaacgcccacacaagcggaccggcacgcaccgcacgctcagaaaagacttgctcaatcgcttcttgcgtccataaacggtagcgttccatgtgcgcagaaaaaaaacactcgtcctcgcacgcaatcctattgtacagccgctcgagtactacatgactaaaaacccccaacacgcgcggatccactaaacgcggccttcgagaaagcggcgccacgtccaacacacgctcaagaaaccaagcagccggacaccgaaaaaaaagattaagatcggtttgactcaccttgaccgccgcatgatgaaaatgacgcgcatggagtactgcagtcagcggtgggagcgcctgcgcaaaggagtcacgtatgtacgaacgccccgctgcagggataagagacgccgctttccgtaaacgctcctgttgtgttctgtacaatgacgaaggcaccggtgcgccctgtgcgtacaggtcctgctctgcctgcagcgcgtcttcctcgtagcgcaccgcaggatactgaggcaccgcgccaccagtttcagatgcaatgcccgctggggacggtgtttgacttgccctccccgtcagggtggaggacacaggcggatgcacatttgaaaaaaaacgattcgggcgctgcacccctgaaaacgcctgcacagaacaggaaaaatacaccgtctgtgccgtcgcgtacgcagataagaaagcctctgttacgtcttcatcttcaaaaccaaatgccgcacgcacatccgcgcgcaaaaaggtacctcgctgataccgcacgctactcgcttcgtgcgacacgtttatcacaaagtgatgcaaaaagggcgcagccgccgcaacccgatagggaaaaatcgccagtcctacccctgcacgcaccggtacatacatctgctgtgccaattgctgtacaaaaaaactatatggatccggtggcaccacgtgtgcaaagcgccgctcaagcgccgctaactcctgcaaaacacagacgcaccgcgccatcaccgcatcgtcttccccagcactgcaagacgcaaacgcagacgatgctatctcctcttctgcaccagacgtgtgcgctgacgcggggagcaaacaagcggcacgaaacgcaccgtaggccttttgcatccgtacgaaactacgcgcctcaaccaacgcgcgcgcaaaacgtaacagcgtcagaaaaaatcgctgcgcacactgctggtgctgtcgctcctgttctgtgcgctcacagtggagcgcaaatgcctggagccacacgttgcaatacgtgccgctctgcttccatgaacgaatgcacgcctgctgcaatccgtactgcaccacagcctgtgccccttgggggtccgcccagcgaatatgcggattcaaaagcagcgcccgcacgcttttgagcgtgccatgactgcgcacaaactctcgaagctgggaaaacatcctccctgccggatgagcaccaagacaaaaacctgcccgcacctcaggctcaatgtcacgcagacgaaactcacgctccacatatggctgcagttcttctaaatttgccaccgaaactgctatctgcgacacaggcgttcccgtgcgcaacaacctctctacctggagcgcaacggcagtaatttcctcacgtacattcgaaaaacaacacaacggcgtatcctgccgaaagggaggaaccggaagaaaggtgagtactcccgcagtggcgcgcgccgcttcttgcaataccggtgcatactctgcaaagtcttgcatcagctgcgggtatacaatgacatacgtgttcccctgcgcacaaaactgcggcgtatcccaggaaggttcaaagagtgcatgcgcgcggagaaattgctcatagtgcgctttcagcgtttgtaaatcttgcgcctccgcactctgcgcatacgcgcgcgcgtcgcggccatcaaacgtattacgcgataccgcatcttttggaggcatgcagtgcgattcaacgcgccgttgccacgatccaagttgagggagtatacgggcaagccactgcacaaacactgcaccgtcttgcgcatatgccggaggaataaggttgcaaaaaagtgcgcgcccctctgcagcctgccgcgcattgcgctgcaccacagagtgtgcaaataaaagacgaagcggttcggaaataggtgtacggtgcgcacacggcgcacattgaaaacatcgttttttaaactcgtcccaagaaagacacaaccgccccggaaccgtacgcacaccaagcagagaaagactttgccgcagccacccctgggcaacaatacgcgaagggaaaacaaaaagacgcctatagggcgtgcggacagtttttatacatgcttcgatttccgtcactccatgctccgtgccttacccgaaggacgtaacacgtatcacgataaattcgccacgagattacgcacccaacgacgtgtttttaagtgacgtgcaagcaccaccatttttactacacttgtactctttactattccatacataagcggcgcaccaagctgagtgaagcgcgccaacacatacatcaacggcaaaaacaacagggtatctaccaacgtttctgtccacgcggtgaccatcacttcacctcctgcacgtgccaccgcatactgcgcatttaaatacatccaaatcggcatatacagcgccgtcacgagcaccaactgctgtgctatacgttgcgaagcatgcgacaaatctccaaaagcccacggaatccctgcacgcgctacacacacaatcacacccaaacctaaccctaaaaagaacgctccgttcatcaaccaccgtgcataatcctgcgcctgctttagctcgcttttccctaacacatccccgaccaaaatggtaattgccacgctacttgcagggaatgatagaaaaaataattgcgcgagtgtccaccccgccgacatccctgccacaacctcagccccaccacggctgtgatacaaggcagccacggccatctccgttaccgaccatgccatgtctcctacgaaaatccacagcgattttctcagcatcaccgtacacagtgacaggggtatcgcacagcgacaaaaaagccgcacataaaagtccggttttttaacccgcacatacaccaggagcataagactttctaccacccgcgctataagcgttgcacatgctgcaccttgcacttctaatcgcggagccccccagtttccataaatcaacatataattacccactgcgttcaatacggcactgcacccgtacactgcaagcggtacaagcaccttccctgtttctcgcaatgtagaggtgaggaccaaagaaaatgacagcggcacaagagtgtacacaattatcgaaaggtaacgctcaccttccgctataatctgagcagcctgcgcattttttcccaacaaacacgaaaggagatactgaggacagcacagcgcagcggccatagcacccagcgccagagaccccatggcgtactgtttaaatcggtagctttgccgcatgcccactacgtgacgggctcctgagtactgcgtcataaacacgctgcctgcattcgacacggtcattaacgcggtgacatacagaaagagcagcgagttgaccacattcactgcacccatcttcacatcccccaaacgggagaccataacgttgtctaaaaaagaaatacccgtctggatgaaggagtgcagcatcacggggagcgcgatgcacagcgcgcgcacataaaacgcacgcggtccgaaacagcgactcagtctcttccccctacagcaactagaaatgtggagcacccgtgcaccgcactcccttttgggtagacatcacgtaacactacgtgcgtaaaaaagcactgacacaagaggcaacctgctcccgctccacgtcatcagtgatcacgtgaccactgtgctcgagcactacgtactggtgtgcgctgcgcacacgcgcatcgagtaatttttgcaccgctgcacacggcaccaatgggtcctgccgagacaggatcgttaacaacgtactccgaatgcacgccagcgaacggatcgcacgtctttgcagtgcgtaaaactgcgccacctgggcaatgtagtgcgcactccggtaatcctttgtggcgtcattaaagtcttgctcggggtagaagggagccgcgtccgcagcaaactcacgcacaaaccacctgactagaggagacagctttatcctccaatcagaaactgcaaaacccggtgcacaaaagaaagctttctggggacaaaaacgcgccgccacgagtgcagtcagcacacctcccatggacagcccccccacagataccgaagggtacgcagcggaaaggtcacggtactcatcacacacgcgccgcagccaatccctccacccggtctcaagaaaatcctctctattcgtaccgtgaccaggtaaacggggaatagagaccgtaaagccgtcccggtggagcgcacgacctaaaaactgcatctcgcgcggggtgcccatgtacccatgaataagcagtactgcatgcgcacccccggcgtaaaacgcgctgcgcacaagaggatgaatgctcgtacaggaagtatgttcagccataagcagatagcgcgcgagggtagtaaaaaagcaacaaaaagtaaagagaaaccgtgccgcgagcaccgcacgcgtctcttgtattgtcacgcgttgcgcggctacaatcggccgcatcgtggagcaggcgcgcgcacttcttcaaggcaaaacggtaaccatcatgggcctcggcgtgcacggcgggggctgcgcggcagcctgcttttgtgcagaagcgggagcgcgccttacggttaccgacctgcgaaatgctgatgcgcttaccccttccctgaaaagacttcgtgcgtacccgtccatccgctttacgctcggtgaacaccggctggaagattttgaaaacgcgcatgttgtcatcaaaaatcccatcgtgaagggtgcacacaacatctacctttccgctgctcaacgcgccggcgcgcgcatcgaaacggatatctcccttttcctacgcctttctcccgccccgctgctagcagtaagcggcagcaagggaaaatcctccactgccagcgccctgtgctacagcttgcgtgcgctgggtttccccgcctttctaggggggaatagcacagtcagcccgctggaatttgtgcgtcacacaacgcctgcaacaccagtggttctggaactgtcgagctggcagcttgcagacctacgcgcagtcgatgcacaggaccacactgtacaccacgccggtctgctgcgcccggagattgccatcatgactcccattatggctgaccatcaaaactggtatgcggatatggaaagctacgtggcagacaaacaggtgctatacgcacaccagggaacgcacgatacactgctgtgtaacgcagatgacgggtggggaccccgctttgcctgcgaagcgcagaaaaacggagtgcgcgtcttttggtatacggcccagtcgcctgagaccgcttgccgcgcgtgcaccccgcgcctcatggagagagctctatggagagcgacggacggaacctactgggcacgttttgcagaaggtgaccgcgcctgcatgctcatcccaccgcagctgcacgtaccgggccgtgtcctccaaacgcaagtggcgagtgcagcgcttgcagcgctcctgttcgcgcagcggcattctctacctccttcctcctgccccccgtgtttttgcgcacactcccattcccccgcgtacgcgaatcacgcgtcccccccagactacgcttgtccgtccgctcacagtcccttccaagagcacacccggcgtcttgcacaagcgctggagtcctacacgggcatcgaacaccgactagagtttttttacgaaaaggggggactgcgtttttataacgattctgcatccactgtacctgaggcaacaattgcagcgctggaagcctttgatgaaagcgtggttcttatcgttggcggcactgataagaatgcagactaccaacccttggcacaggcagcagccaaggcgcacgcattgtacttgcttgcaggaagtgctacggcacggttgcaaccacttcttcatgcagcacaggtacctttttacggaccgtttacttcccttgaggtactcctgcaggatctccgggcgcggcagaaaagcccaggcgtgatcgtgttctctcctggggcagcgagttttgaacttttcgcccacgagtttgagcgaggtactacctttaaatcccaggtgcgtatcatttttgaataagaacacccaagacaaaggcacacccgctgcactgcaggttttccttctcccccaatacaaccgttacagcgcagaaatgacgcgtcacgtgccgctcctctgtaatctattctccatgtcccgttacgtgctcagacacttgacagcacagataattttagaaaggatgagcgcagcctgcgtgtgtctcaggcggaggagacagagtgagtttacggatccgactgaaaaaattggggagtaagaagcgtccgtactaccgaatcgtagttcaggacgcgcgcgagccgagagatggcagggcaatcgaagaactgggtatttaccagcccatagccccaaagggtaccgaggtgtctttccgccttgaccgtgcgcgcttctggcttgagcgcggcgcgcagccctcggatacggtccgcaggctcttgcagtccaggcgtggttctgtcctaaacgcagttgcctcagatgagcgccgtgttgcttcttcacagcaggctgccgatctggcgcacgtagagtccgtttcctgcgccgctccaatcccttcttccccaggggggcagggcgtctaggcaaggggatggtcacgatggaagaagagctaatcgcctatattgcgcgggcgcttgtggatcgtcctggggaggttaccgtcaccaagtctccaggggagggattggagatccttcagttacgtgttgcctctgaagatgtagggaaggtcattggcaagcacggcagaattgcgcgcgctctgcgcacgctcctttctgcgtctgcgcacgcttctcagacgcgttacgctttagagatcatcgactagcggctccttttccgtcttgcggccttgttgcaggcggtgtgtggtgggttatggatagaattgtgactgcacgcatcgtgagcacctttggggttgcgggtttactcaggctcaagagcttctcgggtgagtatgcacatcttgccacactaaagcaggtttgtcttgctcctccacggagcagatcctcaggcaccctcgcttgtgctctcccgcgtgaggccgtccacatggtagagcacgttctcctacgtgcgcaggacgcgctgctcaagctccaccgcgtagatacggtagagtgcgctcggacgtttgtaggagcagagctgcgggtaccgcgtgccgaggcttgtccgcttagcgctggggagttttacctggccgatctgtgtcgttgtgaactcgttttcgagggctcggcggtgggtgttgtcttgagcgttgtcgaagggggcggtagctcccttttagaggttcaaaggacacatggtggcgtttgctatgtgccttttcaccggaccttcattggggacgtggacgttggtcgaaaaaaaatcgagttgttgcagcggtggattctcgaatgaacattgacgtactgactctctttcccgccatcccgcgggtttatttctccacctcaataatggcgcgcgccgtgagcgacgggatcattcactacaatattgtcaacatccgtgactttgcgcacgacaaacacaaacactgtgacgccccgccctacgggggcggacctggcatgctcatgcgctcagaaccgttagggaaggccctggattcagtagacgctcccaaaaagcgcgtcgtgtacgtcactccctctggaaagctctttgagcaaggctatgcgcgctcactcgcacaggaacgtgccctcgtgctcatctgcggcagatacgagggaattgaccaacgtatcatagacgagtatgtcgacgacgaagtttgcatcgggaactacgttctctcctcaggagagatcgccgcgctcgtgctcatcgatgcggtgagccgctgtgttagcggtgtcatccgccatgaatctctcgaggaggaaagttttgtaaacagtctcgtggagtacccgcagtacaccaggccgcgctgttttcacaaccgggacgttccccctgtacttctctccggtcaccacgcgcatatccgcacgtggcggcttgcgcgccagatcgaaaaaacacgaaggaatagacctgacctcctcagcgctgcgcgtgcgtctgcagcctggactcaagaggctgagtcccttcttaaggagttagactatgagttgccacctcatccaacaaattgaaaaccagcagcgaaaggaaccagctgaaacgttccgcgtcggggacaccgtacgtgtgcatttcaaaatagtggagggaaaaacagagcgcatccaagcttacgaagggctcgttctgtgttttaaaaatagcggcgtcaggcgcacctttacggtgcgcaaaaattcctatggcgttggagtggagcgtatattcccgctccactccccccgtatcgagcgggtcgacgtagtacgtgcaggaaaggtgcgacgcgcgaagctctattacatccgagaaaaaataggaaaggccgcccgtatcaaagcacgtattgttaaaaagccgtcgcccagcgcgtgaacggagctgttcgggtagtactcaccgaagtgccgcgcacggtttcccttactgaaggggcgctcgtgtgcgtccgcattctcagcagcacgcacgccggccgtgcgcttgtcgccattaacggtgaacgggtgcgcgcgcgtgtaccgcagcctatgcacaaaggcgcagtcctgtttctgcgcgcgtctatccgcgcgggtacggtgttcctgcacccgcagtgcacgagcactcctccatctgctgaggatatgtcggcgcattttttgcagcgctggggtgtttctttctctcctgaagctgcagcgcttatccacgcgcatacatccctgtgtgtgccgctgcagccgcagctcattgagcgctttgcgcttttgctaaaaaagtttcctgagcaaaaaagagcacacgccgcgttccttgcgagtatcttaggcgaccgaaacattcccgttgatgcagcgatgctccgccgtatgctgagcacctttcttggggaatcaggcgcatacacagactctgacacggagcgagatctctttgcgctcgttaaccacacatatcactcagcactccactggcttcttgtaccctttgagcggcgcggcgcgcacaccgtgtggcgcggcactctctcgctgttattacacctccacaaaaaaacatgcacccagctgcgcgtacgtgcgtgtaacactgcaggagaatgggtcttctgcgtgcagaataacgtactcacggtgcaaagacacgcggcacgggaactgtcgcgcacagcgcagaaaaaaacagttgcacgcctgtgtgccctccttcgcgaacgcggcattgattttttatccgtacggtatggtgcgcatgcagactcggcaaacgatgcggtccccttcaaagggattgacgtttctgtatagcagacgcacactaccgccaccatgaaaagaaagcgtgcgtgctcggttgcgctctcctatgcaacgggagataaggcgcccattattgtcgcttcgggcacgggcgccattgcagaaaaaattgttgaaattgcaaaaaagtttgatatcgccttggtgcaagacgaacttctggcgcgtgttctgtctgagcacaggataggtgcgtgtatcccaccggaaacctatcaggttgtctctgcaatctttgcctttttgtacacacaacagtaacgttaccgctgtgtgtgcataagacgtggtattaacccgtgcgcaccgatgccgaagataaggcgggtaaagaggtacaggtccatgtcacaaaaaatcgatgtatctgaactgcaagaaggaatgtgtttttccgagcccgtgttcttcgacgacggagaaaacctcctcctcagggaaggggagccggtaagcactcgagagctgacggtgctccaggattggaatattccctacgttgtgaccgcaggtagggtgctggctgaaggggagtcagttccctcttctaccgtggaggaattagcagaatttgaagagcttgcagcagaagaactgcttgatcctgaagacgatatcgtttccaccggagaactccgtactcaagatatcctgaaggatatttgtgaactccttcctaaggtgtgtatcaatccccactatcatgaagaatacgttggctttattcaggaattgaacatgctttttgccaagatgaatgcgcacacgacacttcctgcgcgccctgcggacatgcttgcaaagcgcctttcagaattagttcgagcaaatacactcgggtttgtcagtttagtgctgtcatacaaaatcgaaggatttcgatttgcaaaacctgcagtagatacggctatcttttccattatcgttgcgcagcatttgggtttttctgaaaaagatatatttgatttggtcgttgcctcactcctgcacgatatcggtatgcagcatgttcctgccgacatcttgaagaagtcggggagattgcattttcaagaacagcaggcagttgacgcgcacaccatttacgcacattcctacatcgtaaacacgctcaaatacccgaactcggttggactgagtgtactccagcaccatgaacactggaatggaaaagggtatccccagtctctttctggaaacaaaattaccatcggtgcgaggattcttgcagttactgataactttgctgcaatgcttgcgccaaagtcgtatcgcaaaccgttcagtggctatcaagcaatgaaaagcttacttgctgacaacgcacgtcgctttgatccagacgtaatcaaggcaatgattcaaagcgtcggtatttaccccattgggtcgttggtgctcctgaataactcagcagttgcgcgcgtggtaaagaccacggccacggcgccgttgcgtccgtgtttaagaatagttatcgacgagcacgacgtaacccatcctgacgacagcggtgagttcattgatttagcggtcaataaaacgaattacattgtaggagaagtgagtccgtggagttatgccaaagcacaataagttactcggtgcatttggagaggcgtatgcggcgcgctggctagcgacgcgcggatatattatcatcacacgaaactggcgcagagcaacaggtgaaattgatattattgcgcagcaggatgacacaatagtattcgtagaagtgaagacgctacggtgtaccagttacgccgacttagcaattattgttggaaagcgcaagcagaaaaggatctgtgaaaccgctaaacattttcttgccagcgctcgagaatacaaccacatgtgtgcgcgctttgacgtcatcgtgctgcggtccgatccttttcgaaggcaggatgtggacatcgtgcacttgccacatgcctttgaggatttggtatgaaaggttccgtttttccttctcgaggaagacgaagttcccgcagggtgttttgctctgaaacaattcacgaactggaaaagaagattcaagatcagtcctatattgagggggctat

SEQ ID NO: 40 - DNA, 11931 bp, Treponema palladium
tggtgccggctgtggatctggtggatatagggtgaagtgagacaggctgcgaatggatggtgatgcaaagagcggagtgcggaggggtgcgtgagtaatcggtgcgatgtgtctggaaataaggcggtacgcatagcagtttcaggcgcgtcagggtgtggtaataccaccgtgtctgcattgcttgcggaaagactgggacttcccctagtgaattatacgtttaggaatattgcccgggagttgggtatctctcttagtgaggtgctcgagcgtgcgcggacggataatcattttgataaagcagttgatgcgcggcagctctgtcttgcgatgcgttcttcctgcgtggtagggtcgcgcctggccatttggttggtgaaagatgccgcgctgaaggtatatcttttggcttcattaaaagagcgggtgaaacgtgttctccaaagggagggaggggacgtacaggatgttgagcgattcacgtctatgcgtgacgctgaagatatgagtcgctacaaaaagttgtatcgtattgataacacgaattacagttttgcagatcttgttctaaacacagaagggtgcgatcaagaaacagtggtgagtattattattgaaatgttacgcgctagagggatagcttggtagggctgagccaatctgcgggtgatatagaaaagtttcaaaacgccatattggatttttatgcacagcagggcagggattttccgtggagaagtacttgcgacgcgtatgcgatactggtgtctgagtttatgttacaacagacacagacggagcgggtgtgtccgaagtatgcagaatggcttcatcgttttccttctttggagtctcttgcgtgcgctccatttgcgcacgtgctccaagcgtggattggattaggatacaacaggcgcgctcgttttttgcatcagtcggcaaaactcattgttgaaaggtattgtgcagtagttcctgatgacccgagtgaactaaagaagctccccggtgtcggtgactatactgccgctgcagttgcttgctttgcgtacaataaggccaccgtgtttttagaaacaaacatccgtgcagtgtttatacgctttttctttcccgatacgcaccaggtcagtgatcgggagttgctctcgctggtccggtgcaccctgtatgaggaaaatcctcggcgttggtactacgcactgatggattatggggcagttctaaaaaggaagattacaaatcctaatcgtcgcagcaagcattacgtgaagcagtcaccgtttgaaggttctctgaggcaggtgcgtggagcggttttaagagagataagcggcatgcaacacgcggtgcgcgagaaaacgcttttcgcaaagctgtcctttgagcacgaaagattgagccgcgctctagactcgctggtaagcgagggactggtagtaaaaacagaggctgggtattccatcgctgattgattctttatgactcaagacgcttgagtatttcacaaataaagatgcctttctcttttatttcaatggcatctgatgtgaggatcagcatgttgggctgctttgcgtcaaggcgaacgcgatcgttggaggtctgtaccaggcgcagtatctttttgaaggcagtgtcgcagaccttgtcaaactcaatcaataagctttcgtgtgtttctttgagtgagagaatggcgagcttttcgcaccgcactttgatttctgccacggtaaacaacccagctgcttcctcagggataggaccgaaccgggtgatagtttccgtgcgtatgcgctcaagctcctcatgcgtatgagctgcagcgatttttttatacagttccattttaatttcatctgcggcaatgtacgtatgggggatgaaccctcggtaattaagatcgatgacggtttctatcctttgctcgtttggagcatgttggaggcgttctattgcctcttctaacagctgtacatacaggtcgaatccgactgaatagatatctcctgattgttctttgcctaatagatttcctaccccgcgaatctccatatcttttaaggcgactttgaaacccgccccaaggtcagtaaagtcagagatcacctgtaaacgttttattgcaaggtctgaaagtgccacgtcgtgatagtacagcagatacgcatatgcttttttgtcagaccgaccaacgcgtcccctgagttggtagagctgggaaaccccgtacatatcagctctatctatgatgatagtatttgcattgggaacgtcgataccattttcaataatggtggtagaaagcaggagctggaacgttttttgataaaacctttcaaaaatgtcttccagttcttctgaccccatgagactgtgggcaacgcatatggatagctcaggcacgagtttttggagcatacactttacggattctaagttttcgattctgttatgtaggtaaaaaatctgcccctcacgatctagctcttttctgattgcagtggcaacaaggtttggatcaaactgctggataaccgtttctataggtaggcggccttcaggaggggtggtgagcaagctcatgtctctgattttgagcatacccatgtgaagcgttcggggaatgggcgttgcactgagggagagacaatctacattagttttcatctgctttaatttttctttatcctgcacaccgaaacgttgttcctcatcgaggatcatcaacccaagatccttgaaggacacgtccttttggataagccggtgggtacccacaataagatcgatatctccatgcgcgagtttggcgagtatgtccttttgttcagatttaggaacaaagcgtgagagcttctcgattctgacgggaaagtgtttaaaccgattgcagattgtgcgaaagtgttgttccactagtaaggtggtaggggtgaggaacaccacttgttttcctcccattaccgccttaaatgccgcgcgcattgcaatctctgtttttccgtatccgacatctccgcacaccagccgatccatggggacggcttcttgcatatcctgtttgacttcttcaatgcatatgcgctgatcgtctgtttcttcgtaggggaatgctgcttcaaacgcatactgccattcgtcatcttttgggaaggcgtggccgcgcgtagtttttcgcagagagtagagttccactagtttttgcgcgatgttttcaacagattttttgacacgtgcttttctcgtttcccatgactttgacccaaggctatctaagtgaggtttgttcccttcatttccaatgtaacgttgcaccagatgtgcctgctcaatagggataaggatcgtttcttcctgtgcatagaggaggtttacgtaatcacgttctgactgtgctgtttttatgcgctctattcccttaaataaaccgatgccgtactgcgcatgcaccacgtaatccccgggatttaattccacaaatgtgtcgataggcgtgctccgtgcgcgttgcactgattgaggagtttttctgcggcgaccgaagatttcgccttcttgaacgatcagtattttgagagcaggaatgctaaatcctgcagaaagcgcgcaaggtagcacagtgacgtcgcaacctttgactagtgctctgatgcgcagtgcctgctgctcactttctgcaaagacgaaaacgtgccatccgtcttttgaaagacggagtagctcttctttgaagtaaggaatgttaccgaagaagctgcgtgcaggatcgcttgccaagcatatactttcgcacgctggcagctgtggaaaaaagtgagtgaaatacaccgtgtgcaggtggagcgcgcagacagcggaaaaatcgagcactatgtgttctggttgaggataccagcgcgcaggtacatgttcgtgcgcgagttgcattttatggtagaggttccgacactcgtcttggagcgcgcgtgcaccgttgtgctggcgttcgtagtcaagataaaagacgcttgggggtgaagggctgtggcgaaaatattcgagaacgcaggtgggacgttcaaagcacagtggatagaacatttcctccccttcatacgtttttctgtgggtgagttcttcgatacacgggacgcagtgggcaggacattcggacagtttttggagattttggtggaggaacgctatacgctcctcactccaaagaatttcttttgcagcgtacagtgtgcacgcagatacctcttgcaggacggcacacgtggacaccgccagtatatggatacgttctatggtgttaaaatcacacacgattcggtacgcttgtgtgttgtcagcagcctgcgctgcggcagcgatatcgagaatttctccccggagagaaaactctgcgcaagcgctgacgtggtcgacacgtgcatatccccattgcataagctgggcagcgagcgtgtggatctcgatgtgctctcccacacggaaggagcgtttgagggtacgcacataatcgaggggaggaacgggggtgagcagtgcacgctgggtgaaaacgaacgcgcatggcgcggttgcatcgcgctgtgcgagtgcgcacagcgcctctacccggtgagagaacacgtgtgcgttaggtgagacagggcggtagggcagcgacccccaccagggcagcacgcgcgtaggaactgctgcatgtgcaaggtcggtgcagacggcggcgacgtcctgttcggtagggactacgagcactatgtgtgcgcaacacgtgcgcacgtattcgccaaaaaagtaggaccgcagtccaccggtgcacccttcaacgcggtagggaaagcgtgcggcacgcagcgagcgcagcgcatgctggagctcattccaagaatggagtatgccacgcacaggctcctgggtacgagcgtgcatttcttgagcgcgtgttgacacacggccgagtgtaacggagcactgtgccttgtgctagtccctgagcgagaaggatgcagcaggagagggcaagggaggagaacaggaaggagcaccggtagtagttgatggggttaatttttttccgttatgatcgctgctatatgttgtcggtgttgtcgtatcttcacgtgtactttgggccgtttcgtctgttgcaatcttatgcggtgttgatggggattgccctgtatgcgggattcttttttacgtatggggtgttgcccagtgcgtatcgctttttgccccaagacagggggcgtgcgtttgcgccgtgtgcacaggaagcagcgggtaaacccacaggggcaggagtgatttttgtgtccgtctttgtgttgttagtgtacctgcttatgcgtccgagttttgtgcatgcgcttatattgctgctgacgtggggggtgatgctcaccggatacttagacgattgcgcgcaggtgtgctggggggagtatcgcaaaggcgcgttggactttttgtttgcggtgctgacagcagcgctgttgggtcatttttattttcacgatcaggtgttctggtggtttccttttttttcagatccggtgttcgtctctccttttttattttttgccggttcggtggtgattttgtggatgtcaattaacgcaaccaattgcacagacggggttgacgggctttcgggagcgttggtgttgatggcgcttctttcgatgggtacgattttttactttttgttgggaaatgtgcgtgcggcgcagtacctactggtgccgtttgtagtggatggtgcgcaatgggcactgatgagttttgcacttgccggggcgctgatggggtatgtgtggcgtaatgcacaccctagtacggtgttgatgggagacgcaggctcccgtgcgctggggtttttcattggggtgttggtgttgatctcgggcaatccatttttgctgttgatgacaagcggtgttattttggtgaatgggggtacggggcttctaaaagtggtgttgttgcgtttttttcatgtgcggatcctgagccgggtgcgctttccgctccatgatcacatgcgtgagaattggcactggtctacggcgcaggtattgctgaggtttatgattttacagggactgctcacgattggtcttttgggggttttgttcaaactgcggtagagggagggcaccccttgcggggcacgccgggccgagcgagggcgacggtgcggagtatccggcgccttgacgtgcgtttatttcttttgctagcctgcccctaattgctttccgtttccggaatgatggtagaggagacagggcggaaggcgtggggtgtgtatggtgccggtgagaaggttcatagcggtgtgtgcggtgacggcgtgtgccgggccgtgtttttgcgttcaagcgtttatctcttctcggatcgggtatgggcgctttgggatatatgggaacgagataaaggactcctactacaaacatgttccgatgacgggactaggggttgacgtggtaacgtcttcaggcgttgcgatggtgttcaatgtggagactgcgttgacgcagctcatgtttcgcgcgcaggcgctgctggggtacgcgtttgaggttggcaggttccgctttacacctgccattggcggcagtttccttgcgtcgcacgaccacgccgcaggggtggctctgtcgcttgactttcagtatttctttaatgattgggtcgggttggacctgaacataggcgcgggggtggatgttccggtgaacagtaacctgcgttacctgatgcgggtggggacgccggagttagcgaagattctcatcacgcatacagtgacgcatggactggctaatcgctggatatcaggtccccactggtggaattctctttcttcgtgggtcgggaataccgcgggaaaagtggctggatttgtagcgcgtttgatagcaaattatctgctgaaaggctcacagtacagcatgttggtcccagtggttgttcgcctgggggcggtatacaaggtgtgagggagttggcattcggggggcgtgtgcggaaatgaaatggagtgggctctgtctctttctccggacgggggggggggggtgcgaacagatgaacggaaagcgtgtgtttctgggcattgtcgtggtggtctgtgccgcgcgctgtttttgcgcggacgtgttcttctcctcgcatctggggtatgggcgtttctacgccgtggggaaagacattgaggggcagcacatgcacgttccaagcattggcggcggcgtatgtgtggtggcagacagcgggtttgccttcgcctgcacggtggacgcagccctgacccgtataatgctgaaaactcaggcgctctttggctatgcctttcggtggggagcgttcagcctcatccccttgcttgggatggatgtgattgtgtcgagcgaccacgcgtttggtgttgccgcgcaagtgtcgttccagcatttgatttctgagtggtggggctttgccttgagtgtgagcggcggggtggactttccgctcaaccctaacacccgctttttagcaggtaagctgcctgcagaaacggtgcagcgcgtggcgctcgttgcgctgcggcaaaagcttattagcgaagggattatcaaggcattggatttgggctggtttattaccttcgctctgaccgttgttgccgagggattcagttggattgtgtcgcagagcgcttggattgcgcagaaggcggtgaattactttttgagcgacaccacgcgttgtctcattctcccggtcacgctgcgggccggtcctacctttcgaatatagcgtgcgggggggggcggatttagcggcgcgttggcgtccgctgtcgagttgcccagagcgcgagaagaatgcggtcgatttcttgtgtagcgttccgtcgtgcgccgcgcacttgaacgagctcagccggtgcatgagcgaaagcgcgtggacgactgtctgcccgaactttcccggcaggtgcggcggcacgcgcagtatccactttgaaaggtataccatccccgaggccatgcaggcctggcgcgctcctgccgaaagcgcaccgctcgtcagggggaccccaagcaccgttgcccacacgcgtccaaccggcggtctaaggtagcaggcgagcgttcccacccacagccctgccaaggtcatccagcggatgcgtccccccgttgccgcatagagcagcagtgcgatcccgcacacggacgcctgcacgctcagccgcggcacacacagcagtatcaacaggagcaggagtcctgtccccatccgtacataacgcagcacacgcggcctaagcccgtgttccgaacacggcgccgtgcattcacaccccgcctgtaccggaaaaaaaagagacgcaggcggtgcggtgtcttgttgtccgcatgccgcgttctgcaggtgcgcgtaccactgggagtgggagagaaaatggccggttagcgctccgagtaaggtactgctcactgcccccagcgcgcaaaatagcgggagtacgtaccacacccccgcgccaaaaacgagcacccgagcaagcgtaagctgtatcacgtttgaacagaacgcacccatcacgcttatccccacgcacgaaaggtaccggcacgggacgaaccgcagcgcatacatgagcgcacccgaagcggtgctccctgcaagcgagaggacaaatacataagaaaagagcgtcccactcaccagagcctgccctattaccttcaggaatactaaacgcgcgtacgcacagaaagggagcagatccggcgagatcaacagcggcaaattcgcaagccccacgcgaaagaaaggcagcggctttggaatgacgtgttcaaccgtagagagaaagaaacacatgccgcctaaaagcgacactaactcatcgcgtacgtctagtggcagcctgctccgcacgagccgcaccctcccgcgccgctcccacagccaccgccgctggtgctttcccgaaacagaagtgcagctaagtcatcgtccgtcgcctctcgcacagagcgcacagccacctcaaagtggagcgtcttccccgcgaggggatgatttccatctacaataatcgtttcaccttgcacgtcagtgacggtcaccggtcgactgtcacccccgcttcctgcatcaaaccgcatgcccacctctattggcacgtttggaggaaactgatctcgccccactgtcatgcgcaagtcctcctgcacctctccatacgctcctaccggaggaatggttactgaaaactcctccccctcttctcggttaattaaggcggtctcgaggccaggaatgatcatgccgtgcccctgaacatactcgagcgcacccatcacgtcggaagaatcgatgatctcccccgtgtcatctcgcagggtgtactcgatgttcaccacacactcatttgcgattttcatgcgcggcatgctagcacaggcaagatactcacggcaagggcagtttctgtgccgtgtgcccttgacagaatcgccgttataggggataagccgggcgaggtgttgggagcgtgtggtccacttcttgccctcttgcgcggtgctgtgcggtaaaagagggggcgtcgcgttcgagtaaaattttctcttaagccttaagtgagataccccattatggtagaggtctacgcgcggttgcgcgctgctgttgctcggttggcggtctgtagcgctgcggagaaggacggtgccctgcgcgctgtgcgcgatgcgctacatgcgcagcgggaggatatcctgcgtgcaaatgcgcaggatcttgcgcgggcgcgtgaggcgggtcttgccgcaccgcttgtcgcccggctcgcgctgagtgaacaccttcttgaggacatgttgcggtctttgactgttctttcgcttcagcgggatcctatcggggaaattatagaagggtacactcttgcgaatggactggaaatccggaaggtacgtgttcctctgggggtggtggctgtcatctacgagtctcggcccaacgtgaccgtagatgcgtttgcacttgcgtacaaaagcggcaatgcggtgctcctgcgcgcaggttctgcagcgagttattcaaatgccccgcttttgcgcgcaattcacgtgggtttgaagaaagcgcatggtgtcgtggacgcggtggctgttcctcccgttttggaggaaaaatatggtgatgtggatcatatcctccgcgcgcgcggctttatcgatgcggtatttcctcgtgggggggcggcgcttatccggcgcgtcgtggaaggcgcccacgtgccagttattgaaaccggatgcggcgtgtgccacctatacgtagatgagagtgcgaatatcgatgtggcgctgcagattgcagaaaacgcgaagttgcaaaaaccggccgcatgcaattcagtcgaaacgctgttggtgcatcgtgcggttgcgcgtccttttttgcaccgtgtacaggagatttttgccacctgtgaggagactacgcgcaagcccggtggtgtggattttttttgtgatgctgagtctttctcccttctcacagaaaggggcgcgagaaaaaatgtttttcatgcacaggcagagacctgggatcgggaatacctggactatcaggtatccgtgcgggtggtgccaaaccttgaagaagcactcaggcacattgctcgtcattctacgaaacactcagaggttattgtcacgcgcgatcgtgcccgtgcgcgtcgttttcatcaggaagtagatgctgcctgtgtatatgtcaatgcttcaagtaggtttaccgatggagggcagtttggcatgggagcagagattggggtcagtacgcaaaaattgcacgcgcgcggtccgatgggtttgtgtgcactgactacttcaaaatatctgattgatggagaggggcaggtgcgtccgtgatccgtgcgctttttgctgcggcaaaaaaaattgtgataaagattgggtcaaatacgcttgcgcaggcagatggtactcctgatgaggagtttttggcggagtgtgctcgcgcctgtgcggcgctgatgcgtgacggcaagcagatagttgtggtgtcgtctggcgctcaggttgcagggatttctgcgctccattgcctttcatctcctcctcagggggcgggtttagagcgtcacgaatcgcgcggcgttattccgggtgatggtgcgtcctgcaaacaggcgttgtgtgcggtgggtcaggcggagttgataagtcgttggcgttctgcgtttgcagcgcaccagcagtgcgtgggccagtttctgtgtacgaaggaggattttactgactcggaccgcgcggcgcaggtacgctacacgttgtcctttttgctcgagcgcagggtagtacctatccttaatgaaaatgacgcgctctgttgcagcgacgtcccctctgtacccgccgaccggcgggtgtccctatcacctcaaaaaaggattggagataatgacagtctgtccgcgtttgtagcgctgttgtggcaggcagatcttttgcttttgttgagtgacattgacggcgtgtatgacaaagacccaaaggcacacacagatgcgcagcacgttcctctggtgacggacgtgtcagcgcttgtgggtaaaacgagcatgggttcttccaatgtctttggtacgggtgggattgctacaaagctggatgctgcgcgtcttgtcacgagggcgggaattcctctggtgctggcaaacgggcgccatctggatccgatcctgagccttatgcgcggggatgcgcgggggacacttttcgtgcctgtttcttagagagcgacgtgggtatgcgcaagtgcacgcattgtgccctataatgcgcggcgtgcggtcaatttctgacgtgtaatttttctcggtggggcgac

SEQ ID NO: 41 - DNA, 11681 bp, Chlamydia trachomatis
atggttaatagagaacccgatttattaacaagagcataccctcggtatgataggcggatagttagtaaaaattaagtttttttctcttttgctgcaggagtcggtggggtagtgaaagaagctaagagaagatctacagcggtatgcagggaacaagaaaaaatatctagcacaacattcaaaggtgtaatgattcctgcagagatcatgtcttctatttgttgagatacaacattgaagccgagacttggagtccctagagagcagagtttatcagcaacaagttttccatccatatacacagagttaaccagttgttccaagagagtgcggcacgcggtctgtaaaatctgaacagcagcttgttcttcttgagaatgctctggagaggaagagaggctctgagtagcgtaaagaagagccgctccgcctcccaagacgaaaccagattcttgtgttgagtttagcgttttgagagctaattcatgtaggggagttgtgtcctgcttcaccggaatgattgcgatactgttttctaagcgatgttttctttttttaaggagttttcgggatgtttcgtcttctgcgttgtgtatagcgtgatcgagttgtcgaacttttagtttcactacttcaggaaccagattctcacagacaagtaaggtatgatcgcgagatagttctgcccaggtacaggatcctagtagaggcagttctataggaggcttattagagaaaggcggcgaggaaaagaccgttgtccctgtaagcaaagcgatgtcttctaacagagtggtatcggggattgtcactactagaacatccaacagtcccgctatacggtttgcaatgcaggtagctagtgggtcgggagctatctccttacaaaaaatgatcagaggagtttgttcttcggagaatttcttgagtaagggcagaaaaggaaaaagacaatggattttctgatctgtgacaaaaattttaggagctacaataggattttcatgaaaagagtcatgagggaaaaatgacggcactcgatagcccttttgcgtttgtattcctttcaccaggtgtagcgtagagccgcttctttgagataaagcaacagctccttcatgtcctgtataggcaacggcttcagcaaaagcctctccaataagaggatcaggaagatgggaacgaatgagcccgagcacttttgaagcatcttttaagagaaaagagtgcgaatgcagataggcgcacaccgcttctttttgagaggcgagggcagaagctaaaagtcgaggagaaagtccttgatcgataaaaggaatcgatgcctttaaaaaggctcgtaaaagaataacagaagagatcactccatcagcatgacgtttatggatccgttttgctagagatcgagcaaaatagactccaatacgttcgaaaggatcagaaagttctatacgcgaaagaatatgatagcctctccctttgaaaaaatctttcgaagaagaggagtacgcggggccataaaacccctttactatttgatacgccttatcaaggcctgtaaacagttgatgaatagtattgcgatgcatctcattgttgtcgtgaggcatagcggggtatcctgtaacggtttcttcatacctagaacactaccaactcgccagttagatcacaacgagatttaagaaggtggcacccggaatcgaaccggggatagaggctttgcaggcctcggccttaccgcttggcgatgccaccgggagatatccgagtgtacgcgatgttatgaggaaaagtcaataacagtgtgcattttctgggatcttttttttgtaagcaggatgaagaaaaaatttttcctgaagcttttttatatgagtgaaaagcgtttctttagaggttgaattgataatggatatagaataatttttaagactgctagtagaggaaagaaaagagaatctttttaggagatggcgggggagtgcatcttctaaaatctatttctttgagattttttagttgttggtattcggcacgaagccaagggatctgttatgcgccctattttgttggaagaatggtcttctttgttattaggtatggaaatccctcgctcggggaagaaagtgacaggagttgctattgacagtcgattcgtattgcctggggacgtgttttttgctcttcctgggaatcgaacgagtggccacctatttttaaaacaagcagcacaatctggagcagttgctgctgtagtcgcaagcgattatcatggtccaagttacggtctgcagttattgcgtgtggcggatcctcgagaagctttacgggcagcggggcgtacccaaggagctcttttctatggagaagttataggaatcactggatctgtagggaagacaactactaaaaattttgcaaatcagttgctttcttctgtctataaagtctttatgagtcccaaaagctacaattcgcagttgacgctgcctttaagcgttttaatggccgatggggatgaggattttttacttctagagatgggagtttctgaacctaataacatgaagaatcttttggagatcattgagcctacaatcggtgtgatcacacatatcgacgtgcagcatgctgtgcattttctggataaaggggctcaaggtatcgtcgaggaaaaaagcttgctgttggaaagatgtgggttgcagctcattcctaaagactcttcttggtttcagttttttgcaaaaaagaattctgcagcagatcggttttctttttctatgagcaatgaaacggcagatttttattatcgagcgattcattccgaaggagtccttattagtgctcctgatggggacattgagttgcctgccgtatttccgtattctccagcgtatatgaattttattattgcagtagctttggcttggattacgaatgttcccatggatcgtttagagcaggtgagtcagtctctgtttttgcctgccatgcgtttcgaacagcaagagcacaatggtatccgagtgattaatgatgcatataatgctagtcctgatgcaatgctagctgctttagatgctgttcctgttcctccagagggaggtaagatcatttttatccttgggcatatggcggagttaggacgatattccgatgaatgccatattgctgcagctaggaaagctgtgacaaaagctcacatcatcttttttgttggagagaaatggttccctgttagggatatagttcgtgatgcggattgccagattgggttttatagcgcagtgagcgagattatggatgccgtgaaagctctcgttcaacagggagatgttgtgttgttaaaagggtctcgtagtttagaactagagactttattaccatgcttttcgatttcataggtaaaagatcagaatttctttttagaatagaaatagttaactttcaagtcgctgtaagatgctctttttaacttgccttttgaaagcttaagtttaagatagagaatttcttataggagcttcccataataaaacgagaaaacagatgctgcccctaacgtatgttgtgaaagccttttctattggcttgttttttagcctttttttgatgaaacctttgatttcttggttaaaaaaacaaggttttcaagatcatattcacaaagatcactgcgaaaaattagaagagttacataaagacaaagcatatatccctacagctggagggatagtttttgtttttgcatctgtgttggcggttcttttattgttccccatacagctttggtctacatggttttgtattggaactattctattatggggagcattaggatggtgcgatgatcagattaaaaatcggcgtagagtagggcatgggttgtctgctaaacataagtttcttatacagaattgtttggctgcaggggtggttcttcctattatgttcgcatataaagaaagttttcttagttttcatcttccttttctaggaatcgtttctttgccacatcattggtggagctatctactcagttttgctattgcaacattggctattgttggaacgagcaattcagtcaatctcactgatggattggatggacttgcggcaggagctatggtgatagcctgcttagggatgcttgtcgttgcttgtactaatggagctccttgggccttcatttgttgtgttcttctagctaccttagctggaagttgtcttggatttttacgttacaacaagtctcctgcccgtgtctttatgggagatacaggatctttgtttttaggagccatgctcggtatgtgtgctgtattattacgagcagagtttcttctcttgtttatgggagggatttttgttctggaatcactatctgtgattgtacaagtcggaagttataaattaagaaagaaacgagtctttctttgtgcccctttacaccatcattatgagtataaggggttatcagaaaaggctgtagtgaggaatttcttaattgtcgagcttatttgtgtagtagttgggatcattgcagtatttgtggattagaggagagttagatgggattggagcgtgttgtcgttatcggcctaggtgtctctgggaggtctattgcgcattttctagctcaaaaaggtgtatgtgtattgggtgtagacaagtcgcttcatgcacttcagaattgcccgtatattcaggaaaaatatttggagaacgaagagttcccttcacaggtggattatgttgttcgttctccaggagtatccaaggagcatccttgggtacaggctgcgatagcctcgcacattcctgtcatggcagatattcagttagcttttcaaacagaaaaatttacagaaagagagtcgttagcaatcacagggactacaggtaagacaaccacaatattatttttagaatacttattcaaacggtctgggattcctgctttcgctatggggaatgtaggaattcctattttagatggtatgcagaatcctggagtgcggattgttgaaatcagctctttccagctcgctgatcaagaaaaatcctatcctgtcttatctggaggaatgattctaaatatctcagataaccatttagattatcatgggaatttctctgagtattttcaagccaagcaaaatcttgctttatgtatgcgtaatcccgatgacctttgggtaggagatgagcgtttttacggccacttgtatttagaagaagtacagaagtatatgcgtttattagataaagaaagtgcattaaaaccattgtacttgcatgataagtacaactactgttgtgcctatctgcttgctaaaacagaattcccaatatccgaaactagctttatagaagctgtggctacttttaacaagcctcctcacaggatggaatatttggggcaaaagcaaggcatacattatatcaatgatagtaaggcaaccacggtgagtgctacagaaacagctcttttaggggttgggaatcaggcaattgtgattcttggaggaagaaataagggatgcacgttctcttcgcttcttcccgctttgcgaaaagctgcgaagagtgtagtcgctatgggagagtgcgctcaggagatcgctcgagatctagaagagttccctgtaaccgtagtgaaaaatttatctgaggctttactatgtgctgaagagcaagcagtgcctggagatgtgattgtattgtctccggcttgtgctagctttgatcaattccgtagctatgaagagcgaggggcaatgtttaagcagttggttgggatggaagaggttcttttatgaatcgtagaaacacgatgattgtagcaactgctgtgaatgcagtgctattggcagtgctgtttatgaccgcgcgccattcagagcaagaaatagagtattctcagaaaatagctcctattaaaatcttagagcccgttccggttgttgataaggctccagagaagttagagaaaaagcctgaggtgattgcgaagccttctcaggtcgttagaaatcctgtcgtttctaaagctgaacttgctgcgcaatttgcagacaaaaatcctaagacagagaaggaatctagcgggggctctaaagagatttcatctacccctgtagaatcgacgactcctgtcgctccagaaatttctgttgtgaacgctaaggtagtagagaaaactcctgaaaaagaggaattctctactgttattgttaagaaaggagactttttagaacgtatagctagatccaatcacactacagtttctgcattgatgcagttgaatgacttatcttcgacacagttacagataggacaagtgttacgagttcctaaaacgaataagacagagaaggatcttcaagtgaagactccaaatctggaagattactatgtagtcaaggaaggagatagtccttgggccattgcattgagtaatggtattcgtttggatgagctgttgaagttaaatggattagatgagcagaaagctcgtagattacgtccaggggatagattacgaattcgataaatctctggaattattatgaaatggttcctgatttcctgtttattaggaattttttctctcgggctgatcatggtgtttgatacctcatcagcagaggttttggatcgagctttgtcgtgtagtacacacaaagctctgatccggcagattacttatcttggattgggacttggtatcgcttcatttgtgtacatcttaggatggaaggatttcttgaaaatgagccctatgttgctgattttcgtggggattactcttgttttggttcttattccaggtattggtgtttgtagaaatggagctaagcgttggctaggagtggggcagttaactttacagccttctgaatttgttaaatatttagttccatgtgttgctatcgaatgtttaacaacaaaaccttctattcgtagtagttttaaacgattcgtagctttcgttgctctgttgtttatccccattatgttgatagcgattgaacctgacaatggatctgcggccgtgatctcattttccttaattccagtttttatcgtaactgcagtgcgattacgctattggctgcttcctttgctatgtattctgtgtattggaggtacatttgcctatcggctcccttatgttcagaatcgtttgcaagtttacctacatcctgaattagatattaaaggaagaggccatcaaccttaccaagctaaaattgcagcaggctctggaagagtgtttggtaaaggtccaggaaaaggattacaaaaattaacttatcttccagaagctcagaatgattacattgctgctatttacgcagaagagtttggatttattgggatgctcctattgattcttctctacatgggatttatttatagcgggtatgtcattgcaatgcgagcctcccttttatctggagcggctcttgctatttcaatcactgtgattattgggatgcaagcttttattaacttgggtgttgtttctgggttattgcctagcaagggagtgaaccttccattttttagtcagggaggctcttctctaattgctaatatgtgtggcatgggattgctattaaggatatgtgatgaagaaaatcaacaaaatcgtattggcagtggggggaacaggagggcacattatccctgctctagcagcaagagagacttttattcatgaagacatagaagtcttacttttagggaaaggattagctcattttttaggggatgattcagaggtcgcctattgtgatatcccttcaggatcgcctttttctttgcgtgtcaatcggatgttctctggggctaagcagttatataaaggttatgtcgcagctctacaaaagatcagagattttactcctgatttagcaataggatttgggagttaccattccttacctgctatgcttgcttctataagaagtaggattcctctttttctgcatgaacagaatattgttcctgggaaagtgaataagttattttcacgttttgctaaaggtgtagggatgtcttttgcagcagcaggggaacatttccattgccgagccgaagaagtctttctccctatcaggaaactgtctgagcagatcgttttccctggagcttctcctgtcatttgtgtggtaggaggatcccaaggagcaaaaattttaaatgatgttgttccaaaagccttggctcgtattcgagaaagttattcgaatttatatgttcatcatattgtagggcctaaaggagaccttcaagcggtttctcaagtttatcaagatgctggtatcaatcatacagttaccgcatttgatcacaatatgctcggcgtactacaggcaagcgatttagtgattagtagatctggagcaacgatgcttaatgagttgctttgggttcaggtgcctgccattcttattccttatccaggtgcttatggacatcaagaagtgaatgcaaaattcttcacgcatactgtaggtggagggactatgattttgcagaagtatttaacagaagaaagtttgagtaagcaggttttacttgctttagatcctgcaaccagtgaaaataggcgcaaggctatgctttccgcacaacagaagaagtctttcaaatcactgtatcagtttatttgtgaatctctataggctcatgatgaaaagcttgttttaccactttattggtattggtgggattggaatgagtgctttagcacatgttctgctcgatcgaggatatagcgtatcgggaagtgatctttccgaggggaaagtggtagagaagctgaagaataaaggagcggaattctttttagggaatcaagaagaacatatccctgaaggcgctgtagttgtatacagttcaagtatttctaaaaaaaatcctgaatttttatcagctaaaagtagagggaaccgcgtagttcatcgagccgaattattagccgagcttgctcaagatcagatttctatttttgttacaggaagtcatggaaagacaacagtctcttctttaattacagccattttgcaggaagcgaagaaaaatccgtcctttgctataggaggtttgaatcaagaaggcatcaatggtggttcgggatcggaatattttgttgctgaagcagatgagagcgatgggtctattcggtgttatactccagagttttctgttattacgaatatagatgatgagcatctgtctaattttgaaggagatcgagagcttcttctggcttctttgaaagactttgcactcaagactcagcagatctgttggtataatggagattgtcctcgcttgcgttcatgcttgcaagggcatacttttggattggactcttcttgtgatctacatattctatcttattatcaagaaggatggagactgtactttacagcaaagtatcaagatgtagtgtatgcagatatagaagtgcaattggtcggcatgcataacgttttgaatgctgcagcagctatgggaatagctctgtcattgggtatagatgaaggtgctataagaaatgctttcagagggttttcaggagttcaaagacgattacaaagaaagaattcttctgagacctttctctttttagaagattatgcacaccatccttcagagatttcttgtacattacgtgctgttcgtactgctgttggacagagacgtattttagctatttaccagcctcatcgtttttctcgattaagagagtgtatagacagcttcccgtcagcatttaaagatgctgatgaagtcttgttaacagaagtgtacagtgcaggagaggaggcggaagatatttcgtatcagaagcttgctgaagctattagtcaagagtcgatagtaaagtgtacgcatattccgtttcatgagttgcagagacatttagagcagtccatccgtgtacacgatgtgtgtgtatctttaggtgctggtaatattgtgaatttgggagaaaagttaagagattttgagcctcaaaaactgcacttaggaattatttgtggagggaaatcatgcgaacacgagatttccgttctatctgcaaaaaatatagctaaacatctttcaaaatccttttatgatgtgagttattttttaattactcgagaaggattatgggagagcgtctcttcattagagactgctgaagactcagggaaatccgtttttgatccagaaatagctcagagactagaaaaagtagacgtagtgttgccgatactacatggtccctatggtgaagatggagctatgcaaggatttctagagactattggcaagccttatacaggtcctgctatcgctttttctgcgatagcaatgaataaagtgtttactaagcgttttatgagtgatttagggattcctgtcgttccttatctccctttaacattagcaggatggaagcaagaacaagataagtggttagcacatattgtagaggctttttcatttcctatatttgtgaaatcttcgcatttaggatctagtatcggcgtcttcgaagttcataatgttatagaattacgagatgccattaatgaagcttttatgcgagataacgacgtgtttgtagaagaaaatcgcttaggttgcaaagaaatagaagtttctgtcttaggagatggatctggtgcgtttgtcgttgctggtctgcatgagcgtcgtgggagtggaggttttatagactatcaagagaagtatgggttaagtggtaagtctagtgcgcagatcgtatttgatacagatctctctaaagaaatacaggaacaaatactagaagctgcggataaaatttaccgtttattgctagggaaagggtcgtgtcgtattgacttttttgtagatgaagaaggaaatttctggttatctgagatgaaccccattcctggaatgacagaaacgagcccatttcttacatctttcattcgtaaagggtggagttatgaacagatagtccatcaacttgttattgatgggctgcaacgatttaaccaacgccaacgcttgatatcgacgtcttttgtagatcaagcgttcgctattcagtaagctccaacaagagagactctttgttgggcaatcaagctaatcatgatgatgagagcagctacaacctgggcatacacctgcaagagatcgtacaatgaccgaaggttcttcttcgatgctattttcagcaaaagaagaatcttcttcgaaatcttcggcagaagctgcagagatataatctaaagacaaaacttcttcgtctgtgagagagccgttttcaggttgagcaagctcaacaaggatttttttctgcaatctagcgcctacacgttttagaatggttcttagcgcttgtatggtttgtccttttctcccgatgatctttccaatatcttcagaagcggcatggatctccagcttaagggttgcgctggctttgtcctcggatgaccgaatctcaacggcgttgggatcggtaactaaatttttaacgatgtactctgcaaaatcttccataaaatccaatgtaaaatgagaaataaaaaccttgataagagtctcttgcccaagattgtgggaagaatatatgaaattctaaaaaagcgtcaatattttcgcttata

SEQ ID NO: 42 - DNA, 1864 bp, Bartonella henselae
aattctcaacgtgttggtcagtggttgcgtgagagtttttaagtaagtctactgagataaagttaaatttcatcgctttgacttgcgatgtcttatgagaaggaaaaggaaatgacgattaatctgcatcggccagatatcgcggaattgaagccacgtattaccgtttttggtgttggtggtggtggcgggaatgctgtgaataatatgattaatgctggtcttcaaggagttgattttgttgttgctaatacagatgcgcaggctttggctatgtcaaaggctgaacgtgttatccagcttggtgcagcagttacagaaggtttaggtgctggtgctttaccggaagttggacaagcggctgcagaggaatgtattgatgaaattatcgaccatctcgcagattcccatatgattttcattactgctggtatgggaggaggtacgggaacaggagcagcacctgttgttgcacgtgctgctcgtgaaaaaggtattttgaccgttggtgttgtgacaaagccatttcagtttgaaggcgctcgccgtatgaaaacggcagaggctggtattgaagaattacaaaaatctgttgatacattgattgttatacctaatcagaatcttttccgtattgcagatgaaaaaacaacctttgctgatgcttttgctatggctgaccaagtgctttactctggtgttgcttccattacagatctcatgattaaagaagggctcattaaccttgattttgctgatgttcgttctgttatgcatgaaatgggccgtgcgatgatgggaaccggcgaggcatctggtgaagggcgtgctttggctgctgctgaagcagctattgctaatccgttgttggatgatacttctatgcgtggtgctcgcggtcttttgatttctattactggtggtcgtgatatgactttatttgaagtcgatgaagctgctaatcgtattcgcgaagaagtggatgcagatgctaatgttatctttggtgctattgatgatgagtcactagagggtgttattcgtgtctctgtggttgcaacggggatcgatcgtgaggttagtgatttagttcagccttctcatcctcaacttcaaagacatgcaacttcaattcgtaagaacgatcctggaatgccgcaaagttcttttcatgttcaatcaccacccttgcgctctgagtcaatggtagaagtgatcgaagcacttgaaatagaaaagggcaaaacggttggagagcagtttcgtcctaaaagtcaaatttttgcacagcctgcagacactgttgctgcacgaaatgctgccgctgcttatgggtcaagtgctcatgggcagatatcaaatgcgccacgtgtgcaagtaagccgtagttcgcaatcctctatggttgcaccagtgagtatggaggcgacggcgcatgttcttgatgagatgacaggcgttgtgcagcaaaaagaaaatcaagtaaaacaaatacaagcgcgttcacctatgcgtatgcctgagttaaaggattttcctcctgttgctcatggtcaaggtgagaggtcatctgctgaccaaggacctcgcaatctttggcagcgtttaaaacaaagtttgacacatcgtgaagaggctgagccagaagctaagctagagcccgctgtaagatcttctcagcagcaagaagttcgtgttcataataaaaattctcgggcacttgttcaagatgcttctgtttatgttccacgtcgtgctggtgagttgcatccccatgtttcacaagatcagcgtaattttgtaagtgaagaagatcagttggaaataccagcatttttacgtcgccaagcgaattaatgaatac

SEQ ID NO: 43 - DNA, 10271 bp, Hemophilis influenza
ttagcgtgaaaatagacaggtacacagcctgtctaaatgaatataaaagtgcggtaaatttaaggtatgaatttacacacgagcaagataggcttgctctgcatttgcatcaaaaatttcttgttcttcagtcagtataacaccttgtaaatcttcggctaatgtatgggcagcacgcatcatcatacgtaaattagcaagattattacctggagagggcaattgcataaataatacaattcctatggtgttaaattccgctaagttataagcattgaatgtgccgggttgttctaaattggccacactaaaaagcacaggacttgccacacttaaatctaagtgacgatgatacatttcatctttacccaagataaaacccaagttttcaagagcctgcaccaatttagcaccattaaattcttcgctagattttggaataagataaagttgaatatagccagttgtttgttttggatgagctgtcgtttctgcttttggttcattgaacgagaggttgtagtctacttgatgttcttcgtgagataattctgcaagctgcactcttaattctggcgatgatgaattaatgccattaaaaccaacattttgactttgtgcttcaagttgttctaaggtcatacttgcgacattatttgcggttggcatatcgtattgaggttgcgttggttgtattggctcggaacgatgattccccatatcataaataggttgcgtgttaggaatagaaattttgatgtcatccacacttttatcgctttggcgataatcgatcaattcagcttctgatggtaatttttctgtggtcggttgaggaattggtgtatgcccattttccacataggtatttggcgaaatattgtttggctgtaccatttcttcttgcgtatgggatctagatgttagagaagtgcggtcaaatttattggctttatcaaaatattttgatttctcacgacgatttgaccataatccgtgtacgattaaggcgacaagtgccacgatacccacaataatcaaaattgtatttaaatccatttttattccttacgcgcgatagttcggcgagagtgctataaatggtgctaatgctaccatatttcagtaggtgaaaaaatacttcaaagtgtggaattttaaaggaaaagtgcggtctgttttaagcatatttttattgaaaggaaagaaaaatgttgaatcttaatgaattaaaatctggtttccattattttgtgatgggttggcatttcatcacacaaaaaggtttgcgtcggtttgttattatgccaattgtgctcaatactgttttgctttgtggtttattttggctttttattagccaaatcagcagtgctattgattgggtgatgaattttattccagattggcttagttttctcagtgtcattttactgatactttcgattttaacgattttattgctcttttattttaccttcaccacaatttctggctttatcgcagccccctttaatggtttgttggcggaaaaagtagaaaaaatgctgacgggggaaaatattaatgatgatggtctcgtggatataatgagggatgtgcctcgtatgcttgctcgagagtggcaaaaattacgttatagcctacccaaaattatcgccttatttttactgagttttattcctttggttgggcaaaccatcgtgccagtacttactttcttgttcacttgttggatgatggcaattcaatattgtgattatccttttgataatcacaaagtctcttttgatatcatgaaaaatgtgcttggcaatcaacgaactcaaagtttaacttttggtggattggttacttgttgcacatttgtgccagtgattaatttattaattatgcctgttgcagtatgtggtgcgacgctgatgtgggtggaaaattatcgtaatgacttaggttttaatatgaataaatctttttcctctcaaacagggcttgatgttcgttcagaaaatacagggattgttaaatagcctacagttataaatagatcaaataactatttttttaatcaaaagtgcggtactataaataaaccaacattaacgaagtccaacgaaaggaaaatattatggcaatttatgcagacaattcttattctatcggaaatacgccgcttgtgcgtttaaaacactttggccataacggtaatgtggtggtaaaaattgaaggtcgtaacccaagctacagcgtaaaatgccgtattggggcgaatatggtgtggcaagcagaaaaagatggcacgctcacaaaagggaaagagattgtagatgcaacgagtggtaacacgggcattgctttggcttatgttgcggcggctagaggttataaaatcacgctcactatgccagaaacaatgagtcttgaaagaaaacgcttattgtgcggattgggtgtaaatttagtgcttaccgaaggcgcaaaaggaatgaaaggtgctattgcgaaagcagaagaaattgttgcttctgatccaagccgctatgtcatgcttaaacaatttgaaaatccagccaacccacaaattcatcgagaaacaacagggcctgaaatttggaaagatacggatggcaaagtcgatgttgttgttgctggcgtaggaacaggtggttcgattacgggcatttctcgcgcgattaaattagattttggtaaacaaatcacttctgttgccgttgagccagtggaatctccggtcattagtcaaactttagcgggtgaagaagtaaaaccaggcccacacaaaattcaaggtatcggtgcgggtttcattcccaaaaatttagatttatctattattgatcgcgtagaaactgttgatagtgataccgcacttgccacagctcgtcgcttaatggcggaagaaggaattcttgcaggtatttcatctggtgcagctgtcgcggctgcagatcgcttagctaaattaccagaatttgctgataaactcattgttgttattttgccttcagcgtctgaacgctacttaagcacagcactgtttgaagggattgagggataaataaaaaagaaaaaagtgcggtgaatttttaccgcacttttattaagactagagtagttcaatctgaatgacatcatattggtaagaattatagcgaactagattgcaaggttggttcgcaaattacagtaagaataaatttaggaactgtacaagataaccagaacaaacttcccttaactaattgttttaaaattgaaatttgagattttatttcactgttgttaaaacgtcattcacattcctttaaatgtagctcccaatgctctttgggaatacgtattaaacttgcgtaaatagcgttttgctttattccaaaaatgctcaattccgtttatgttcttgacgttggcaagcgtgaacacgctgaagtttacactgctgcaagcgatagattaaattaatctatattaatgatattagttgttattaatcacaaattaatttacatagcaccctatctttgataccagtgagaataaacaattatgactaaaccccagtaaaatcaaggcataagcgttaaaatttgttgttcttgctcactagcatcctaatttaatccccttattttatcctttccttcttattcaaaatcaattttttcttcttttcatattctgttcattgaatttttttattaatgcagtaaactagccaccgatttttaatcatctttcttttcactttaaatgttacccgcgagtaacaaaaggacacatcatgacaaacaaagtaaacagttatggctggaaagccttaattggctctgccgtcggctatggaatggacggtttcgatcttctcattttaggtttcatgcttagtgcaatttccgcagacttaaatctaacacccgcccaaggtggctctctcgtaacttggactctgattggtgccgtatttggcggcattttatttggtgcattaagcgataaatacggtcgtgtacgcgtactgacttggactattcttctttttgcggtgtttactggtttatgtgcgattgcacaaggttattgggatttactgatttatcgcacaattgctggcattggcttaggcggtgaatttggaattgggatggctctagcagcggaagcatggcccgcacgccacagagctaaagcagcatcttatgttgcattaggttggcaagtcggtgtgttaggtgcagcattgcttacaccattattgctcccacatattggctggcgtggaatgttcttagtgggtatcttccctgcatttgtcgcttggttcttacgttctcatctgcacgaacctgaaattttcacgcaaaaacaaaccgcactttcaacgcaatccagctttactgataaattacgttcatttcagcttctgattaaagacaaagccacgagcaaaattagccttggtatcgtcgtactcacttctgtacaaaacttcggttattacggcattatgatttggttacctaatttcttatcaaaacaacttggattcagtttaactaaatctgggctttggacagccgttaccgtctgcggcatgatggctggaatttggattttcggacaactcgccgaccgcatcggacgcaaaccaagtttcttacttttccaattaggcgcagtgataagtattgtggtttactcacaacttaccgatcctgacatcatgcttcttgctggggcatttttaggtatgtttgtgaacggaatgctgggcggttacggtgcattgatggcggaagcctacccaacagaagctcgagcaacggcacaaaacgtacttttcaatattggtcgtgccgtagggggatttggacctgtagttgtgggctcagttgtacttgcttactctttccaaactgccatcgctctacttgcgattatctacgtaattgatatgttagcgacaattttcttaatccctgaattaaaaggtaaagccttagactaagaaaatataaaagataaaaatgttcgccaagtgcgagcattttttatgaaacaagtcatcttataagtaatatctttataagttttcttttcactaagcaaactttcattattttgccaacagttcgttcaatttttctaatgccatttctggcgtaatatcaatcaaactttgatgatacccaccctctttgtcgcctttacggactttaattaattcaccttcaattaaacgaataatcgttgctttatctgaaagcggcggcgtatattgtgggctagttggtccataaagtgcaatcaatggacgatttactgctgccgcaatatgcattaaaccactgtcattggtcacgactgccgtacaatttgcaattaaatccaccgcttcattcaagttggtttttcctgctaaattgacacaaaactcacgcaactcttctggcagcgcttgacgaatttcttcgcccacaggttcatctttagcagaaccaaatagcgccacagcatagccttgggtaattaacatttctgctaattttgcataatgataatgtggccaacgttttgctgggccaaattccgcaccaggacaaaaaccaataattggacgctcgcctaaaagtgcggtttgtttttcaaatttttttaaggtttcagcttgttgcgctggctcaaccgtcaaatagggtttcaagacaggaatatcatcagcttttggtataacatctttttcaaaagctaatgcaacataacgctgcaccatcattggataatcttttttattggctcgtaaatcattcaataaaatataacggctttcgcctttccaaccgcgacgatggacaatttttgcgaagaaaggaataaacgccgatttcaatgaattaggcaaaacaattgccatatcatattgttcacgcaaagactttcctaaacgataacgcgttcccaattcaaaggccccgtgccctaatggcatttcaatcgccttacgcacctctggcattcgcgcaagcaaaggcttacaccaattcggtgccatcacatcaatattgcagtttggatattgaattttcagttgctggtacaagctgtgcgacatcatcatatcgccaacccaagatgggccaataattagaatattcattttctgtctttcagataaaagtgcggtcaaaaatacttgttattatggcacagagttgaataaaaatatgctcctttaacaatttagtcgaaactctttaggagtcatttcaaattctttcttaaaaacagaataaaaatattgaattgatggatagccgcaaatctcagtaatttctttaatagaaatatctgtttgttgtaataaattctttgctcgggaaattttttcttcgtggatgacttggtgaattgttttattcatttcattcttaaaacgttgttcaagattagaacgtgaggtttcaagatgatctaaaacttgtcctactttaattcgatgacaggcacgatgacgaatataatgcattgcttgaatgacaagcggatctgttaatgatcgataatctgtagaatttcgagagtgaacggtaatcggtggaattaaaataggggtatgtgaaactttttgaccattgagtaatttgtgtaataatttcgcagcttgataaccaatctctctcgtgccttgttctacggaggaaagggacatacgcgataaatattggatcaattcttcattatcaataccaaccacacaaagctcttcaggtacagcaattttactgtactcacaagcctgcaataaatgacgagcacgcgcatccgtaacagcaataataccagtatgagaaggaagagattttaaccagacaattagcttttgttgctcttccaaccaattttgagcatgaacctgcacaccctcatataggtaaatagggtaatgatttttctccatcaactctacaaaagcatctcttcgttctatagaccaatgcttatgagtatttacttgcaaaccataaaatgcaaactgtgacagtcctttctcctgtaaatgagataaagccatttcaaccaatgccatattatctgttgctatataaggaaagtgcggataaaaatcagcttgtttataagatccaccaactgctatagtaggaataagagtgtgttgcaataattcaacagtttttggatcatcaaagtctgcaataatgccatcaatagaaagttgattaatggtatcagtatgatagataaattcatcttctacaaaaatatcccacatacattgcgatgcctgaatatattgtccaataccctccaccacctgccgatcatatactttgtttgcattaaataagagggcaattttgtagtattgttccgtcattttatatccttatctatgggaaattgctatttaagttataatagaaaagatatttagcttcaagataaaaatagccagaataactggccatttttatatccaataccacatttatttttttagcttcgcaatacctattccacttgcaccataaataatagcaaagataataccgctccaacataaaattgcccaaggtaaataagacaatgttgcaacacctaatgtgcctgccatatatgcacctgcggcagtccatggcaaaataggttcaataattgttgcggagtcttctgctgttcgacttagattttttggatgtaatcctttttctacatacgcatttttaagcatttctcctggaattagaatagaaatttgcccattacaagtaaccccaatcattgttagaccgcaaagaatcgttgtaataatcaaagaaagagttgaatgaacaaaggtgagtaatttttgaataatcacggttaatgcaccgctcaattgtaatacacctgcaaatgacaatgcacagaaacaaattaatagtgttcccatcattgagttcattccaccacgattcaacaaacgacttaaatcagagctaactgaagtatggtgaatcattgaggtatcaaatccattaactgcactattaatcacatcagatagagagaatttttgaattaagatagcattaataattgcgataaatgctgataataacatcactggaatagtcggtttcttagtaatagatccccataatacaatagcgactggaataagtaatagaaagttaaaatgataaacttgctctaactcatgaatcattgtatttactttttctggagtcgctacattagaaaaatcgtagtttaaaccatataccacatagacagtagccgaaagaataaaagatggtaatgttgtataaagtaagtgagcgatatgctcatataaatctacgccagcagctgcggatgcaatattggttgtatcagataatggcgataatttatctccaaaatacgcaccagcgaccacagcacctgccgtagcagccaaattggcgtctaatccaatcgcaactcccataaatgccacaccaacagtccctgctgacccccaagaggttccagtacaaatggaaacaatagcagtaaggaataaggctgtcacataaagatattctggtgatatcgcttttagtccgtagtagatcatcataggaattgttcctccactaatccaagttccaattaataatcctacagtaattaaaattaatagcgcaggcattgttttagctattttttctgaaatggcatctaaaatatctaaatagcaatgacctaatttaaaaactaaaaaaccagcaaataccgttgaaataatcattaatggctctgctggcaaatcaaataaagcatacccaagccctaacagtaatagcatcacaatgattggtgaaaaagcttctaatgttgttggcattcttgtgcgatgagtggttttcatattaaatctccctattgtttaataaacaaaacccatttttgattcgattcaatgcttctaataatttttttctaggcatagcgacattcatacgaaagaaaccatctccctctttgccaaattcactccccaaagatacttttactcttgataaattattaatccaataagctaattcattttcatttatacttagctttttatagtttatccaaagtaaataagttccatcactttcagtaatatctaataatggaatatactcattgaaaaattcttttactatcttcttattattctttatgtattcttttagatagattacccaatcagtacaatatttatataacgaaataatagctggtatagagaaataatttggattatgtatacctaatgccatcatttattttataaattgttctcgaatttctttattctcaataattaggttagctatttccaatccaggaatattaaaagtttttgctggggataaacagatcattgagtgatttgctacccattcatctaatgatgatattaaatagtgggagtcatttgttagtgtaaagtctgcgtggacatcatcggaaatgataaatatattatgttttttagctaagtttataattttaataaggacttctttattccaaatcgttccagttggattatgaggagaaattaaaacaaatactttagaatgtttaaaacattcctctaataaatgaaaatcaatatgatactttctattttcataaaccaaaggacattgatataattttctgtcatttaattttatcgtgtttaatattggactatatgaaggtgatagaatacatattccatcagtttcttttgtaaatgctcgtatataaatagatacggcttggattattcttgggcaaaatacaattttttcagagagaacagaataatgatattgttcgaaaatataatcactgattatcttgtaatagtcggctggtaattcagtataaccataaattcctaaacgattaaatttttctaattcatctatcattatctgaggggctggaatatccatatccgcaacagacattggaataatatcattatctacattccatttagcactaaatgtatttaggcgatcaataatcacatcaaaattataaaaattattcattattcctcctgatgtataaggcaaatttactttagtcaaagaagaaaagaattaaaattactaaaactactttatctattacgttttttcacaactgtgatctagtccacaattgtaaataatcactataaaaaattaaataatgtaacggataagaacttgttt

SEQ ID NO: 44 - DNA, 11498 bp, Hemophilis influenza
gttgctttaatgtggaattacttgcaagttgagcgaacaaattataaacttgccagaagtggagaaaagtggtgttttgtggagatttttagagattttctaaaaataagttcaatttttaaggcgtaatatgtttcgtggtgcaacggcggttaatttagattctaagggacgtgtagcgattccaactcgctatcgcgctgaaattcttgaaaagaaccaagggcaaatggtttgtactgtagatattcgtcaatcctgtcttttactttatccccttgatgaatgggaaaaaatcgaacaaaaacttctcgcactttctaactttgatcctacccaacgccgtttgcagcgagtaatgcttggtcatgccactgaatgtgagatggatgctcagggtcgtattttgcttagtgggccattacgccaacacgcaaaattagaaaaaggtttaatgttggtagggcaacttaataaatttgaaatttggagcgatgtagaatggcatactcaaattgcagaggatatagaaattggctccagcacagattttgctgctgatgcgttaaatgatttctcattatagaaaataatgtagtacttttatcttaaatttatgaatagcgaaaattccttttcttcatctgaacatattacagttttacttcacgaagccgtgaatggcttggcattgaaggagaatggcatttatattgatggtacttttgggcgtggggggcattctcggtttatcctttctcaactttcttctaatggtcgtttgatagctgtagatcgcgatcctcgtgctattgcagaagcacacaaaatccaagacttgcgttttcagattgaacataacagcttttcgcatattcctgaaatttgtgacaaattaaatttagtgggcaaaattgacggtattttgcttgatcttggtgtgtcttcccctcagcttgatgaagcagaacgtggttttagttttatgaaagatggcccgcttgatatgcgtatggatacaactcaaggtttatctgctgaagaatggttaaaacaagtgtccattgaggatttaacttgggtgttgaaaacttttggcgaagagcgtttcgctaaacgtattgccactgctattgttgatttcaataaaagtgcggtaaaaaatggcacagaatttttatcgcgtaccagtcaattggcggaacttatttcacaggcagttccttttaaagataaacataaacatcctgcgacgcgtagtttccaagctattcgtatttttattaattcggaattagatgaattagaaagtctgcttaattctgcgttagatatgttagcaccagaaggtcgtttatcaattattagtttccattctttagaagatagaatggtgaaacattttatgaaaaaacaaagtaagggcgaggatattcccaaaggtttaccattgcgagaagatcaaattcagcgtaatcaaaaattaagaattattggtaaagccattcagccaagtgatgcagaaattcaagccaatcctcgttcaagaagtgccatattacgtgtggcagagagaatttagcgatgtctgaaaataataagcctcgttatccgttacagcagattttagtcgaagatttattttcttcaaataagttagtggtgttgctgttaatagggattttagtttctgcaatggggacgatttggataacccataaaactcgccaattaatttctgaaaatggaatgttaattttacagcgtcaagcacttgagaatgaataccgtaatttacaagtgcaggaagctacggaaggggatagcacgcgagtagaatctattgcgattagtacattaaaaatgaaagttgtttcttcagagcaagaagttgaaattagagaataataggtaaaaaaaatggtgaaatttaattcctcgcgtaaatcaggtaagtcaaaaaaaacaattagaaaattgaccgcacctgaaactgtaaagcaaaacaagcctcaaaaggtgtttgaaaaatgctttatgcgtggacgttatatgctttctacggttcttattttacttggcctgtgtgctttagtcgcacgagcagcttatgttcaatctattaatgccgatacgttatcgaatgaagcggataagcgttctttgcgtaaagatgaagtattatcggtgcgtggttctattttagatcgtaatggtcagcttttatctgtaagcgtgccgatgagcgcgattgtggcagatccaaaaacgatgttgaaggaaaattcgcttgcggataaagaacgaattgcagctttagccgaagaattaggtatgactgaaaatgatttagtgaaaaaaattgagaaaaattctaaatctggttatttgtatttagcacgtcaagttgaattaagtaaagctaactatattcgtagattaaaaattaagggtattattttagaaacagagcatcgccgtttttatcctcgtgtagaagaagctgcacacgtggtgggttatacggatattgatggaaatggtattgaaggcattgagaaaagttttaattccctgcttgttggtaaagacggttcacgtactgttcgtaaagataaacgtgggaatattgttgcacatatctccgatgagaaaaaatatgatgcacaagatgttaccttaagtatcgatgaaaaattgcaatctatggtgtatcgtgagattaaaaaggcggtgtctgagaataatgctgagtctggtactgcggtgttagttgatgttcgaacaggggaagtgttagctatggcgactgcgccctcttataatccaaacaaccgtgtcggcgtgaaatcagagttaatgcgtaaccgtgcaattaccgatacttttgagccaggttctacggtaaaacctttcgttgttttaaccgcacttcaacgaggtgtagttaaacgagatgaaattattgatactacgtcctttaaattaagcggtaaagaaattgtggacgttgcaccacgtgctcagcaaactttagacgagattttaatgaactctagtaaccgtggtgtaagtcgtcttgcattacgtatgccacctagtgcattaatggaaacttatcaaaatgcaggtttaagtaaaccgacagatttaggcttgatcggagagcaagttgggattttgaatgcaaatcgtaaacgctgggcagatattgagcgtgcaacagtcgcttatggttatggtattactgcgacacctttacaaattgctcgtgcctatgcaacccttggtagtttcggtgtttatcgtccgctttctatcactaaagttgatccgccagttattgggaaacgggttttctctgaaaaaataactaaagatattgtgggaattttagagaaagtagcaattaaaaataaacgcgcaatggtggaaggctaccgtgtcggcgtaaaaacaggtacggcacgtaagattgaaaatggacattatgtaaataagtatgtggcatttactgcgggtattgcaccaattagtgatcctcgttatgcattagtggttttgatcaatgatccaaaagcaggagaatattatggtggtgcggtttctgcccctgtattctctaacattatgggctatgcgttacgtgcaaatgctattccgcaagatgctgaagcagctgaaaacacaacaacgaaaagtgcaaaacgtattgtttatattggcgaacacaagaatcaaaaagtgaattaaggaaaaattatgaaaaaactcaccgcactttttaatttgcctgaattaaagaatgatatagaactccataatatggtgttagatagccgtaaggttaaagctggcgatctttttgtggcgataaaaggtcatcaggtggatggaaatcaatttattgattctgctcttcattctggtgcgagtgcggtggtttctgagacagaattatccagcgagcatttaactgtagcgtttatcgggaatgttcccgtagtgaaatattatcaacttgcacatcatctttcatctttggcggatgttttctatgattcgccctctaacaatttaacccttgttggtgtcacggggacaaatggcaaaaccactatttctcaattattagcgcaatgggcggaattattggggcatcgtgcggctgtgatgggaaccattggtaatggactttttgggcaaattgtagaagctaaaaatacgacaggttcagcagtagaaattcagtcatctctttcagctttcaaacacgcaggtgcagattttacctctattgaagtttcatcacacggtttggcgcagcatcgtgtagaagccttgcattttaaagcagcaattttcacgaatttaacccgtgatcatctagattatcatcaatctatggaaaattatgctgcagcgaagaaacgcttgttcactgaattagatacccaaattaaagtgattaatgctgatgatgaaattggataccaatggctaactgaactacctgatgctattgccgtaagtatgaatgcggattttaaagtaggttcacaccaatggatgaaagcaataaatatccattatcattttaaaggtgcagatattacttttgaatctagctggggtaatggtgttttgcatagcccattaattggtgcttttaatgtaagtaatttattattagtaatgaccacgttgttatcgtttggttacccattggaaaatttactcgctacggcgaaatctttaaaaggagtatgtggaagaatggaaatgattcaatatccaaataaaccaaccgttattgtagattatgcgcatacaccagatgcgttggaaaaagcgttgattgctgcgcgtgaacattgccaaggcgaattatggtgcatttttggttgtggcggagaccgtgatagaggcaaacgtccgttaatggcacaggttgcagagcagtttgctgaaaagattattgtgacaaaagataatccacgaacagaatcacaaagccaaattgaaacagatattgtcgctggctttaaaaatatggaaaaagtggggattattcctgatcgcgcacaggcgatccagtttgcgattgaaagtgcggtagaaaatgacgtgattttaattgctggaaaggggcacgagcattatcaaattattggttcggaagttgtgcatttttccgaccaagaaattgcacttgatttcttaaaataataatcactcaattatgattaaactctctactgtacaacttgcacagattcttcaagctaaattaattggcgatgaaaatgtgcaagttgaaaaaattaatacggatactcgaaaaagcgtatcaaatagcttattttttgctttaaaaggcgaaaaatttgatgctcatcaatatcttgatcaagcggtgtcacagggtgcgcttgcgcttgttgttcagcaagaaaattcatccatttctgttccacaattggtggttaaggatacccgtattgccttgggtgaacttgcaaaatggttacgtgagaaaattaatccacgtactgtggcgatgaccggctcttctggtaaaaccacggtaaaagaaatgacggcaagtattttgcaacataccgcagcggattcagaagcggtactttttaccaatggtaacttcaataacgatataggtgtgcctttaactctacttcgcttaacagaaaaacatcgttttgctgtgattgaacttggtgcaaatcatcaaaatgaaatcaattacaccacaaaattagttcaacctaatgccgcattgattaataatattgcgcccgcacatttagaggggtttggttctttagcgggggttgttcaagcaaaaggcgagatttatcgaggtttaacaaaaaatggtgtggcgattatcaatgctgaacataatcacttagatatttggcaaaaagaaatcagtaatcacgccattcaatatttcaacggtaaagattattctgcaaaaaatattcatcatacttctcaaggctccacttttacacttatttccccacaaggtgaaattgagattaccttaccttaccttggtgaacataatgtaaaaaatgccttggcagcgaccgcacttgcaatgaatgtcggtgccactcttacagatgtaaaagctggattagaacaacgttcacaagtgaaagggcgtttattccccattcaagtcacgcctaatttattgctgttagatgatacttataatgcgaataaagattctctgtgtgctgcgattgatgttttaaaaggttatgatgctttccgtattttgtgtgtcggtgatatgaaagagctaggcgaaaactctctcgctattcatcgtgaagttggacaatatattaatttggtaaatttagatttagtgtgttcttatggcaatgaaagtgcggttatttctgaggctgtttcgggtaagcattttacggataaaactgaaatggtggatttcttagttccacttattgaaaaccaattacaacaaaataaaaaagttgtggtgctaggaaaaggctcacgctcaatgaaaatggaagatgtgatctattcattaaaggataaaattaaatgttagtctggcttgctgaatatcttgttcgttacgaaaccgcgtttaatgctatttcttatattacagtccgcgcaaatcttgcattattaaccgcactttttatctcactttggattggccctaaagtgatcaaacgcttgcagatcttaaaatttggccaagaagtgcgaaatgatggccctgaaagtcactttgcaaaaaaaggcacacccactatgggtggtgtgatgattttattctctattggcgtaagtacgttattatgggcaaatcttgctaatccgtatatttgggtttgtttatttgttttatttggatacggcgcaattggttttgtggatgatttccgtaaaattacccgtaaaaatactgatggattgattgctcgttggaaatatttctggatgtctgtggtggcattagtggcaatcctttggctttattggcttggtcacgacactgatgccacccgtttagtgattccattctttaaagacattatgcctcaattaggtttgttctatattgtgttatcttactttgtgattgttggcacgggtaatgcagtgaatttaaccgacggtttagatggattagcgattatgcctactgcgcttgttgcaggtgcgtttgctttaattgcttgggctacaggtaacgtgaatttcgcagaatatttgcacattccgtatattaaatacagttctgaagtagtggtgttctgtacagctattgttggcgcgagtttgggattcttatggtttaatacttatccagctcaagtatttatgggggacgtgggttctctagcattaggtggtgcgctgggtgttgtagcaattcttgttcgtcaggaatttttgcttgtgataatgggtggtgtatttgttgttgaagcactctctgttattttgcaagtagggtcttataagttacgcaaacaacgcatttttagaatggcaccgattcaccaccattttgaattgaagggatggcctgagccaagagtgattattcggttttggattatttccttaatgctggtgttgatgggattggtcaccttgaagttgcgttaataaatatagctaggttcgctctttcacttttgaaagagcgaccttttttacgttagtaaaggaaatttatatttccatcaatgatataattttaaaatttatagcaattaagaagaaagaaaatgaacgcctatcaaaacaaaaatattactatcatcgggcttggcaaaacaggtctttcttgtgtggattatctcttatcccaacaggctaatattcgtgtgattgatactcgaaaaaatcctactggtattgataaacttcctcaaaatatccctcttcatactggtagtttaaatcaggaatggttacttgaaagcgatatgattgttattagcccagggcttgcggtaaaaacaccagaaattcaaaccgcacttaaagcgggagtggaagtaatcggcgatattgaattattctgccgcgcagcgacaaagccaattgtggggattacaggttcaaatggtaaaagtaccgtaactactttagtttatgaaatggcgaaagctgctggtgtgaaagttggtatgggcggaaatattgggattcccgctttgtcattgttgaatgaagattgtgaactttatgtactagagctttctagttttcagcttgagacaacttatagcttaaaagctgcggcagcgactgtcttgaacgtgactgaagatcatatggatcgctatatggatttagaagattatcgccaagcaaaattacgcatttatcataatgctaaagtaggtgtgttgaacaatgaagataggctgacttttggggaaaacgaaaatcaagcgaaacataccgtttcttttgcggaaaatagtgcggattattggctaaaaactgaaaatggcaagcaatatttaatggtaaaagatgaagtgattttaccttgtgaagaagctacattggttggtcgccataattatatgaacattttggcagcaacagcattggcacaagctataggtattaatttagattcaattcgtaccgcacttcgtcatttcaaagggttagatcatcgttttcaattagtgcatcaagctaatggcattcgttggattaatgactctaaagcaacaaatgtggggagtacagttgctgcattggctgggctttatattgagggtaaattgcatttgttgctaggcggagacggaaaaggggctgatttttcagaattagctgaattaattaatcaaccacacattatttgttattgttttggtcgagatggtgcgctgcttgcaaaattttcatcgcaaagttatttgttcgatacaatggaacaagcgatagaatttttacgcccaacattgcaaagcggagatatggtattattgtcgcctgcttgtgcaagtctcgatcagtttgcttcttttgaaaagcgcggcgaagaatttacgcatttagctcaatgtttaacctaatttagtaactcacgaaataagatggaatttttacaaaatatcaaaaaaaattacgatgaatggacacgcatcacacctcaaggtttgttgtatgatcgcgcactattttggttatttgttattttgcttttaattggtttagtggcagtaacatctgcttctattccttatagctctcgtttatttaatgatcctttttactttgcaaaacgcgacgctatttatgtgctactttctttactcacttgttatatttcattacaaatttcttcttcgcaatgggaaaaatggcacgctaaaatttttttattttctgtcatattattattgcttgtcccttttatcggtacatcggttaatggcgcaaaacgttggatttcgttgggaatcttaaactttcaacctgcagaatttgcaaaattggctttgacttgttttttagcaagttatttcactcgtcgttatgatgaagtgcggtcgcgacatgttagtatttttaaaccgtttattgttatgcttgtattgggttgttttcttttattgcaacctgatttaggtagtacagtcgtgctatttattattatgtctgggatgctttttatcgtaggggcgaaaattttacagtttgtaggattgatagcattaggtggaatcttattcgtttggctagtattgaccgcctcttatcggttaaagcgatttataggttttttagaaccctttaaagaaccttatggcactggtttccaattaacaaactctcttatagcatttgggcggggagaaattactggcgaaggattaggtaattcaattcaaaaattagactatctgcctgaagcacataccgatttcattatggcgattatcggcgaagaatttggatttatcggtatattgattgttattcttttattaggtttattaatttttcgtgcaatgaaaattggacgagaatccttaatgttagaacaacgttttcgaggtttttttgcattaggtattggtttttggattttctttcaaggctttgtgaatttaggtatggctcttggaatgctaccaactaaaggtttaacctttccactcgtgagttatggtggttcgagtattatcattatgtccgccactattggtattttattgcgaattgatcacgaaaatcgtttatttcgtataggtcaagcacgcttgcgtgatgattagagatagaaaagatgaaaaataaaaaattattagtgatggcgggtggtactggcggtcatgtttttcctgccattgcagttgctcaaactttacaaaaacaagaatgggatatttgctggttaggtacgaaagatagaatggaggctcaacttgtaccaaaatatggtattcctattcgatttattcaaatttctggtttgcgtggtaaaggtataaaagctttgttaaatgcgccttttgccatttttcgtgcggtgttgcaggcaaaaaaaattattcaagaagaaaagcctgacgctgtacttggtatgggaggctatgtttctggccccgctggcgttgcggcaaaactttgtggtgtaccaatcattttacatgaacaaaatgcgatagcgggtttaacgaataagttattaggtaaaattgcaacctgtgtattacaggcatttccaactgcttttcctcatgctgaagtagtaggaaacccagttcgagaagatttatttgagatgccaaatcctgatattcgtttttcggatcgtgaggaaaaattacgtgtcttagtggttggtggtagtcaaggagcgagagtgcttaatcatactttacctaaagtagtcgcccagcttgcagataaattagagtttcgtcatcaagtaggtaaaggtgcggtagaagaagtcagccaactttatggcgagaatttagaacaagttaaaataacagaatttattgataatatggcagaggcttatgcttgggctgatgtggttatttgccgttctggcgcattaaccgtatgtgaaattgcagcagtgggagccgcagcaatttttgtaccattccaacataaagatcgccaacaatatttaaatgcgaaatatttatcagatgttggcgcggcgaaaattatagaacaggcagatttaacgcctgaaattctagtgaattatttaaaaaatttaactcgtgaaaatttattgcagatggcattgaaagcgaaaacaatgtcgatgcctaatgcggcacaacgtgtagctgaagtaattaaacaatattcaaactaggggttgtggcgttttataaatagcctcagtcataagtattttttatatccaaaagtgctaatattagaaataaaaacgttgcgaattttaaccgcac

SEQ ID NO: 45 - DNA, 23 bp, Artificial Sequence
  oligonucleotide
gcattcaccacatcacaaaattc

SEQ ID NO: 46 - DNA, 19 bp, Artificial Sequence
  oligonucleotide
caaacatagtttctctccg

SEQ ID NO: 47 - DNA, 20 bp, Artificial Sequence
  oligonucleotide
gattagcataataaaatctc

SEQ ID NO: 48 - DNA, 21 bp, Artificial Sequence
  oligonucleotide
ttttgtttccatagttagcta

SEQ ID NO: 49 - DNA, 21 bp, Artificial Sequence
  oligonucleotide
taacgttttcattatcgcgtc

SEQ ID NO: 50 - DNA, 21 bp, Artificial Sequence
  oligonucleotide
gtgttttaaatgcttaaaact

SEQ ID NO: 51 - DNA, 21 bp, Artificial Sequence
  oligonucleotide
cgccttgatcattgttgttct

SEQ ID NO: 52 - DNA, 21 bp, Artificial Sequence
  oligonucleotide
tggttcaaacatagtttctct

SEQ ID NO: 53 - DNA, 21 bp, Artificial Sequence
  oligonucleotide
aaggccaggatgtcaaacacg

SEQ ID NO: 54 - DNA, 21 bp, Artificial Sequence
  oligonucleotide
ttgtgtattcattctttacgc

SEQ ID NO: 55 - DNA, 21 bp, Artificial Sequence
  oligonucleotide
ccaaactaacatgtcccattc

SEQ ID NO: 56 - DNA, 21 bp, Artificial Sequence
  oligonucleotide
aatcgttttcatcttaatcca

SEQ ID NO: 57 - DNA, 21 bp, Artificial Sequence
  oligonucleotide
atcctgcatcattatattctc

SEQ ID NO: 58 - DNA, 21 bp, Artificial Sequence
  oligonucleotide
tgaagtgtacataatcaatcc

SEQ ID NO: 59 - DNA, 19 bp, Artificial Sequence
  oligonucleotide
gtgaccccatcattatgag

SEQ ID NO: 60 - DNA, 21 bp, Artificial Sequence
  oligonucleotide
gagaatataatgatgcaggat

SEQ ID NO: 61 - DNA, 21 bp, Artificial Sequence
  oligonucleotide
aatgtgaatatgaacaaaaat

SEQ ID NO: 62 - DNA, 21 bp, Artificial Sequence
  oligonucleotide
cagttcaaacatttcccctct

SEQ ID NO: 63 - DNA, 21 bp, Artificial Sequence
  oligonucleotide
agcggttttcatcaggagcaa

SEQ ID NO: 64 - DNA, 21 bp, Artificial Sequence
  oligonucleotide
atatgcgggcatttacccgtt

SEQ ID NO: 65 - DNA, 21 bp, Artificial Sequence
  oligonucleotide
aacaaattccattcaaaaact

SEQ ID NO: 66 - DNA, 21 bp, Artificial Sequence
  oligonucleotide
tgttttagtcatgttaaccac

SEQ ID NO: 67 - DNA, 21 bp, Artificial Sequence
  oligonucleotide
taaaaatcccatttcgttcgc

SEQ ID NO: 68 - DNA, 21 bp, Artificial Sequence
  oligonucleotide
aaattctaacatttaaatttc

SEQ ID NO: 69 - DNA, 21 bp, Artificial Sequence
  oligonucleotide
atgttcttccatagataggca

SEQ ID NO: 70 - DNA, 21 bp, Artificial Sequence
  oligonucleotide
gacaaaatgatagtgtgtcat

SEQ ID NO: 71 - DNA, 21 bp, Artificial Sequence
  oligonucleotide
ataattaagcatcttaatgca

SEQ ID NO: 72 - DNA, 21 bp, Artificial Sequence
  oligonucleotide
tcagtttggatgcaagtacgt

SEQ ID NO: 73 - DNA, 21 bp, Artificial Sequence
  oligonucleotide
tacaaaaatcataactatctc

SEQ ID NO: 74 - DNA, 21 bp, Artificial Sequence
  oligonucleotide
agccgaacgatgacccccccg

SEQ ID NO: 75 - DNA, 21 bp, Artificial Sequence
  oligonucleotide
ggtgctgggatgacggaacac

SEQ ID NO: 76 - DNA, 21 bp, Artificial Sequence
  oligonucleotide
ggtgatccggtaggcgggggc

SEQ ID NO: 77 - DNA, 21 bp, Artificial Sequence
  oligonucleotide
gcggcgcgcatgatcgagctg

SEQ ID NO: 78 - DNA, 21 bp, Artificial Sequence
  oligonucleotide
tgtgcgcccatgaggcagatc

SEQ ID NO: 79 - DNA, 21 bp, Artificial Sequence
  oligonucleotide
tgcttttatcatggtagtagt

SEQ ID NO: 80 - DNA, 21 bp, Artificial Sequence
  oligonucleotide
tttatgttccatgatttcccc

SEQ ID NO: 81 - DNA, 21 bp, Artificial Sequence
  oligonucleotide
ttgatgaaccatagctacttt

SEQ ID NO: 82 - DNA, 21 bp, Artificial Sequence
  oligonucleotide
gagaaaattatgcttgaaacc

SEQ ID NO: 83 - DNA, 21 bp, Artificial Sequence
  oligonucleotide
agaaattttcattttaacaca

SEQ ID NO: 84 - DNA, 21 bp, Artificial Sequence
  oligonucleotide
tttaagcttcattctttaagc

SEQ ID NO: 85 - DNA, 21 bp, Artificial Sequence
  oligonucleotide
agaatagagcataaaatccct

SEQ ID NO: 86 - DNA, 21 bp, Artificial Sequence
  oligonucleotide
tttacttgacatatcggtcac

SEQ ID NO: 87 - DNA, 21 bp, Artificial Sequence
  oligonucleotide
ttctctagccattacatcgct

SEQ ID NO: 88 - DNA, 21 bp, Artificial Sequence
  oligonucleotide
tgaaaatgtcataatttattt

SEQ ID NO: 89 - DNA, 21 bp, Artificial Sequence
  oligonucleotide
tattactttcatgtctcgaac

SEQ ID NO: 90 - DNA, 21 bp, Artificial Sequence
  oligonucleotide
ggaaataaacatattagtctc

SEQ ID NO: 91 - DNA, 21 bp, Artificial Sequence
  oligonucleotide
cagtactccatgctcgtacgc

SEQ ID NO: 92 - DNA, 21 bp, Artificial Sequence
  oligonucleotide
aacctcacccataactttcct

SEQ ID NO: 93 - DNA, 21 bp, Artificial Sequence
  oligonucleotide
tatattcatcattcccctccc

SEQ ID NO: 94 - DNA, 21 bp, Artificial Sequence
  oligonucleotide
cccccgcttcatgggcggatt

SEQ ID NO: 95 - DNA, 21 bp, Artificial Sequence
  oligonucleotide
aattaaccccatcaactacta

SEQ ID NO: 96 - DNA, 21 bp, Artificial Sequence
  oligonucleotide
gcttttcatcatgagcctata

SEQ ID NO: 97 - DNA, 21 bp, Artificial Sequence
  oligonucleotide
taggggcagcatctgttttct

SEQ ID NO: 98 - DNA, 21 bp, Artificial Sequence
  oligonucleotide
ctccaatcccatctaactctc

SEQ ID NO: 99 - DNA, 21 bp, Artificial Sequence
  oligonucleotide
gaaccatttcataataattcc

SEQ ID NO: 100 - DNA, 21 bp, Artificial Sequence
  oligonucleotide
caaagataacattagcatctg

SEQ ID NO: 101 - DNA, 21 bp, Artificial Sequence
  oligonucleotide
ggaataaaaatggatttaaat

SEQ ID NO: 102 - DNA, 21 bp, Artificial Sequence
  oligonucleotide
ccagactaacatttaatttta

SEQ ID NO: 103 - DNA, 18 bp, Artificial Sequence
  oligonucleotide
gaccatttttttccccat

SEQ ID NO: 104 - DNA, 17 bp, Artificial Sequence
  oligonucleotide
gatgaacgcatatgtag

SEQ ID NO: 105 - DNA, 17 bp, Artificial Sequence
  oligonucleotide
gccgtctttattcattg

SEQ ID NO: 106 - DNA, 18 bp, Artificial Sequence
  oligonucleotide
cttcatcaaacaattaac

SEQ ID NO: 107 - DNA, 18 bp, Artificial Sequence
  oligonucleotide
cattcctttcgccccctc

SEQ ID NO: 108 - DNA, 18 bp, Artificial Sequence
  oligonucleotide
taaattcattgtcgttcc

SEQ ID NO: 109 - DNA, 18 bp, Artificial Sequence
  oligonucleotide
ggtatccatcattgcgcg

SEQ ID NO: 110 - DNA, 19 bp, Artificial Sequence
  oligonucleotide
caaacctatcatctatttc

SEQ ID NO: 111 - DNA, 18 bp, Artificial Sequence
  oligonucleotide
gatgttcatttgaccttc

SEQ ID NO: 112 - DNA, 18 bp, Artificial Sequence
  oligonucleotide
cttaacataaaattactc

What is claimed is:

1. A substantially uncharged antisense oligomer containing 10 to 40 morpholino subunits, each of said subunits supporting a base-pairing moiety effective to bind by Watson-Crick base pairing to a respective nucleotide base,
   wherein said base-pairing moieties include a targeting nucleic acid sequence having the sequence presented as SEQ ID NO: 47,
   and wherein adjacent subunits are joined by uncharged linkages selected from the group consisting of uncharged phosphoramidate and phosphorodiamidate, or by charged linkages selected from the group consisting of charged phosphoramidate and phosphorodiamidate, the ratio of uncharged linkages to charged linkages in the oligomer being at least 4:1.

2. The oligomer of claim 1, wherein each said uncharged linkage is a phosphorodiamidate linkage as represented by $-P(=O)(NR_2)-O-$, where R is hydrogen or methyl.

3. The oligomer of claim 2, wherein each said linkage in said oligomer is an uncharged phosphorodiamidate linkage as represented by $-P(=O)(NR_2)-O-$, where R is hydrogen or methyl.

4. The oligomer of claim 1, wherein the length of said oligomer is less than 30 subunits.

5. The oligomer of claim 1, wherein the length of said oligomer is less than 25 subunits.

6. The oligomer of claim 1, wherein the length of said oligomer is 20 subunits.

* * * * *